United States Patent 12,622,926 (IMMUNOTHERAPY TARGETING TUMOR NEOANTIGENIC PEPTIDES) - sequence listing, part 4

SEQ ID NO: 13009 - DNA, 2485 bp, Artificial Sequence
  Synthetic polypeptide
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatcccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag

SEQ ID NO: 13010 - DNA, 2656 bp, Artificial Sequence
  Synthetic polypeptide
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgagaatcctgaccttgggccagatctcgggtgcccagagcttttctccagatgggacccacctgacgggaacggagtttcttggaggctggagctggaggcccagccagatcaggctgatgagccctgggacccactggggagaccttactgccacagagattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaaccagatatagctgagaagtacctgtcggcttcagagtatgggagctccgtggatggccaccctgaggtcccagaaaccaaagacgtcaagaagaaatgttctgctggcctcaaactgagcaacctaatgaatctgggcaggaagaaatccacctcactggagcctgtggagaggtccctcgagacatccagttacctgaacgtgctggtgaacagccagtggaagtctcgctggtgctctgtcagggacaatcacctgcacttctaccaggaccggaaccggagcaaggtggcccagcaacccctcagcctggtgggctgcgaggtggtcccagaccccagccccgaccacctctactccttccgcatcctccacaagggcgaggagctggccaagcttgaggccaagtcttccgaggaaatgggccactggctgggtctcctgctctctgagtcaggctccaagacagacccagaagagttcacctacgactatgtggatgccgatagggtctcctgtattgtgagtgcggccaaaaactctctcttactgatgcagagaaagttctcagagcccaacacttacatcgatggcctgcctagccaggaccgccaggaggagctgtatgacgacgtggacctgtcagagctcacagctgcggtggagcctaccgaggaagccacccctgttgcagatgacccaaatgagagagaatctgaccgagtgtacctggacctcacacctgtcaagtcctttctgcatggccccagcagtgcacaggcccaggcctcctccccgacgttgtcctgcctggacaatgcaactgaggccctcccggcagactcaggcccaggtcccaccccagatgagccctgcataaagtgtccagagaacctgggagaacagcagctggagagtttggagccagaggatccttccctgagaatcaccaccgtcaaaatccagacggaacagcagagaatctccttcccaccgagctgcccggatgccgtggtggccaccccacctggtgccagcccacctgtgaaggacaggttgcgcgtgaccagtgcagagatcaagcttggcaagaatcggacagaagctgaggtgaagcggtacacagaggagaaggagaggcttgaaaagaagaaggaagaaatccgggggcacctggctcagctccggaaagagaaacgggagctaaaggaaaccctactgaaatgcacagacaaggaagtcctggcgagcctggagcagaagctgaaggaaattgacgaggagtgccggggcgaggagagcaggcgcgtggacctggagctcagcatcatggaggtgaaggacaacctgaagaaggctgaggcagggcctgtgacgttaggcaccaccgtggacaccacccacctggagaatgtgagcccccgccccaaagctgtcacacctgcctctgccccagactgtaccccagtcaactctgcaaccacactcaagaacaggcctctctcggtcgtggtcacaggcaaaggcactgtactccagaaagccaaggaatgggagaagaaaggagcaagttag

SEQ ID NO: 13011 - DNA, 922 bp, Artificial Sequence
  Synthetic polypeptide
aggaatacttcttacaactgagtatcagaaagaaaatggccacccctgaagaactgccctggaacagctgctgacagagttggatgacttcctcaagattcttgaccaggagaacctgagcagcacagcactggtgaagaagagctgcctggcggagctcctccggctttacaccaaaagcagcagctctgatgaggagtacatttatatgaacaaagtgaccatcaacaagcaacagaatgcagagtctcaaggcaaagcgcctgaggagcagggcctgctacccaatggggagcccagccagcactcctcggcccctcagaagagccttccagacctcccgccacccaagatgattccagaacggaaacagcttgccatcccaaagacggagtctccagagggctactatgaagaggctgagccatatgacacatccctcaatgaggacggagaggctgtgagcagctcctacgagtcctacgatgaagaggacggcagcaagggcaagtcggccccttaccagtggccctcgccggaggccggcatcgagctgatgcgtgacgcccgcatctgcgccttcctgtggcgcaagaagtggctgggacagtgggccaagcagctctgtgtcatcaaggacaacaggcttctgtgctacaaatcctccaaggaccacagccctcagctggacgtgaacctactgggcagcagcgtcattcacaaggagaagcaagtgcggaagaaggagcacaagctgaagatcacgccgatgaatgccgatgtgattgtgctgggcctgcagagcaaggaccaggctgagcagtggctcagggtcatccaggaagtgagcggcctgccttccgaaggagcatctgaaggaaaccagtacaccccggatgcccagcgctttaactgccagaaa

SEQ ID NO: 13012 - DNA, 303 bp, Artificial Sequence; identical to SEQ ID NO: 6723
  Synthetic polypeptide

SEQ ID NO: 13013 - DNA, 189 bp, Artificial Sequence; identical to SEQ ID NO: 6724
  Synthetic polypeptide

SEQ ID NO: 13014 - DNA, 318 bp, Artificial Sequence; identical to SEQ ID NO: 6725
  Synthetic polypeptide

SEQ ID NO: 13015 - DNA, 138 bp, Artificial Sequence; identical to SEQ ID NO: 6726
  Synthetic polypeptide

SEQ ID NO: 13016 - DNA, 809 bp, Artificial Sequence; identical to SEQ ID NO: 8586
  Synthetic polypeptide

SEQ ID NO: 13017 - DNA, 809 bp, Artificial Sequence; identical to SEQ ID NO: 8587
  Synthetic polypeptide

SEQ ID NO: 13018 - DNA, 809 bp, Artificial Sequence; identical to SEQ ID NO: 8613
  Synthetic polypeptide

SEQ ID NO: 13019 - DNA, 174 bp, Artificial Sequence; identical to SEQ ID NO: 8969
  Synthetic polypeptide

SEQ ID NO: 13020 - DNA, 861 bp, Artificial Sequence; identical to SEQ ID NO: 8970
  Synthetic polypeptide

SEQ ID NO: 13021 - DNA, 846 bp, Artificial Sequence; identical to SEQ ID NO: 8971
  Synthetic polypeptide

SEQ ID NO: 13022 - DNA, 690 bp, Artificial Sequence; identical to SEQ ID NO: 8972
  Synthetic polypeptide

SEQ ID NO: 13023 - DNA, 879 bp, Artificial Sequence; identical to SEQ ID NO: 8973
  Synthetic polypeptide

SEQ ID NO: 13024 - DNA, 154 bp, Artificial Sequence; identical to SEQ ID NO: 8974
  Synthetic polypeptide

SEQ ID NO: 13025 - DNA, 1533 bp, Artificial Sequence; identical to SEQ ID NO: 8543
  Synthetic polypeptide

SEQ ID NO: 13026 - DNA, 1267 bp, Artificial Sequence; identical to SEQ ID NO: 6631
  Synthetic polypeptide

SEQ ID NO: 13027 - DNA, 263 bp, Artificial Sequence; identical to SEQ ID NO: 6632
  Synthetic polypeptide

SEQ ID NO: 13028 - DNA, 809 bp, Artificial Sequence; identical to SEQ ID NO: 8643
  Synthetic polypeptide

SEQ ID NO: 13029 - DNA, 2983 bp, Artificial Sequence; identical to SEQ ID NO: 8169
  Synthetic polypeptide

SEQ ID NO: 13030 - DNA, 3010 bp, Artificial Sequence; identical to SEQ ID NO: 8170
  Synthetic polypeptide

SEQ ID NO: 13031 - DNA, 588 bp, Artificial Sequence; identical to SEQ ID NO: 7495
  Synthetic polypeptide

SEQ ID NO: 13032 - DNA, 454 bp, Artificial Sequence
  Synthetic polypeptide
gagtgtgggcgcgaggcagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 13033 - DNA, 7988 bp, Artificial Sequence; identical to SEQ ID NO: 8551
  Synthetic polypeptide

SEQ ID NO: 13034 - DNA, 1301 bp, Artificial Sequence; identical to SEQ ID NO: 8552
  Synthetic polypeptide

SEQ ID NO: 13035 - DNA, 1808 bp, Artificial Sequence; identical to SEQ ID NO: 8393
  Synthetic polypeptide

SEQ ID NO: 13036 - DNA, 809 bp, Artificial Sequence; identical to SEQ ID NO: 8699
  Synthetic polypeptide

SEQ ID NO: 13037 - DNA, 207 bp, Artificial Sequence
  Synthetic polypeptide
ggccgggcgcagtggctcacgcctgtaatcccagcactttgggaggctgaagggggtggatcacctgaggtcaggagttcgagaccagcctggccaacatggaatgatgagaagacagcagctgattacaagattttagtgatggaactgtacgagataggcggggccaagacgtccgactgtacccagaggtgcctgaggtcctaa

SEQ ID NO: 13038 - DNA, 198 bp, Artificial Sequence
  Synthetic polypeptide
ggccgggcgcagtggctcacgcctgtaatcccagcactttgggaggctgaagggggtggatcacctgaggtcaggagttcgagaccagcctggccaacatggaatgatgagaagacagcagctgattacaagattttaggtggttcagtccttcacctggtgttggctctgagaggaggaggtggtcttaggcagtga

SEQ ID NO: 13039 - DNA, 962 bp, Artificial Sequence
  Synthetic polypeptide
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctga

SEQ ID NO: 13040 - DNA, 986 bp, Artificial Sequence
  Synthetic polypeptide
ggctggccgtggtttctcatacctgtaatcccagcgctttgggaggctgagagctgatgccttcctccagactgtggagcctctcctataccaaattgccctcctctctccaatccacagggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcctgggcaccgtgactgtgatcagccccctggagcttatgcggacaaagctgcaggctcagcatgtgtcgtaccgggagctgggtgcctgtgttcgaactgcagtggctcagggtggctggcgctcactgtggctgggctggggccccactgcccttcgagatgtgcccttctcagccctgtactggttcaactatgagctggtgaagagctggctcaatgggttcaggccgaaggaccagacttctgtgggcatgagctttgtggctggtggcatctcagggacggtggctgcagtgctgactctaccctttgacgtggtaaagacccaacgccaggtcgctctgggagcgatggaggctgtgagagtgaaccccctgcatgtggactccacctggctgctgctgcggaggatccgggccgagtcgggcaccaagggactctttgcaggcttccttcctcggatcatcaaggctgccccctcctgtgccatcatgatcagcacctatgagttcggcaaaagcttcttccagaggctgaaccaggaccggcttctgggcggctga

SEQ ID NO: 13041 - DNA, 399 bp, Artificial Sequence
  Synthetic polypeptide
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcaccatggatgccttcgtgaagatcgtgaggcacgagggcaccaggaccctctggagcggcctccccgccaccctggtgatgactgtgccagctaccgccatctacttcactgcctatgaccaactgaaggccttcctgtgtggtcgagccctgacctctgacctctacgcacccatggtggctggcgcgctggcccgcc

SEQ ID NO: 13042 - DNA, 203 bp, Artificial Sequence
  Synthetic polypeptide
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagaccctacccgcttcactggcacc

SEQ ID NO: 13043 - DNA, 186 bp, Artificial Sequence
  Synthetic polypeptide
ggctggccgtggtttctcatacctgtaatcccagcgctttgggaggctgagagctgatgccttcctccagactgtggagcctctcctataccaaatggaagtgcctcctgtattgcaatggtgtcctggagcctctgtacctgtgcccaaatggtgcccgctgtgccacctggtttcaagacccta

SEQ ID NO: 13044 - DNA, 122 bp, Artificial Sequence
  Synthetic polypeptide
ggctggccgtggtttctcatacctgtaatcccagcgctttgggaggctgagagctgatgccttcctccagactgtggagcctctcctataccaaattgccctcctctctccaatccacaggg

SEQ ID NO: 13045 - DNA, 809 bp, Artificial Sequence; identical to SEQ ID NO: 8699
  Synthetic polypeptide

SEQ ID NO: 13046 - DNA, 763 bp, Artificial Sequence; identical to SEQ ID NO: 606
  Synthetic polypeptide

SEQ ID NO: 13047 - DNA, 1447 bp, Artificial Sequence; identical to SEQ ID NO: 9968
  Synthetic polypeptide

SEQ ID NO: 13048 - DNA, 1828 bp, Artificial Sequence; identical to SEQ ID NO: 9969
  Synthetic polypeptide

SEQ ID NO: 13049 - DNA, 1443 bp, Artificial Sequence
  Synthetic polypeptide
cttctagaagaaaacatctccatgatcttgaggagtgccagcttctctcagggcaccagagcctcttttctcatgaggagtgacacagctgtacaaaaacttgcccagggcaatggacactgtgtcaacgggatcagtggtcaagtccatggcttctatagccttcccaagccgagccggcacaatacagaattcagagacagtacctacgacctcccccgcagcctggcctcccatggccacaccaagggcagcctcacaggctccgagacagataatgaggatgtgtacaccttcaagacgcccagcaacaccctgtgcagggagttcggggacctcctggtagacaatatggatgttccggccaccccactctcagcctaccagatccctaggacattcactctggacaaaaaccacaatgccatgacagtggccactcctggggactcagccatagctcccccaccccgcccccccaagccaagtcaggcagaaacacctcgatggggcagtcctcagcagagaccgccaatcagtgaaaatagcagatctgtcgctgccaccatccccagacgcaacaccctccctgcaatggacaacagccgacttcaccgagcttcttcctgtgagacctacgagtacccacagcgtggtggagagagtgcaggccggtctgctgaatccatgagtgatggagttggctctttcctgccagggaaaatgattgtgggccgatcggacagcaccaattctgaagacaactatgtgcccatgaatccaggttcttccaccctgttggccatggaacgagcaggtgataattcccagagcgtctacatcccaatgagcccaggggcccatcactttgactcacttggctacccatcaacaacccttcctgtgcaccgaggccccagcagaggaagtgagattcagccaccccctgtcaaccgcaacctcaaacctgatcggaaagcaaagccaacaccacttgacctgaggaacaacaccgtcatcgatgaactccccttcaagtcacctatcaccaagtcttggtctagggccaaccacaccttcaactccagctcctcccagtactgccgccccatctccacccagagcatcaccagcacagactcaggagacagcgaagagaactatgtccctatgcaaaacccagtgtctgcatctcccgttcccagtggcacgaacagtcctgcccctaagaagagcaccggcagcgttgattatctggccctggacttccagccgagctccccaagcccccaccgcaagccatctacttcatccgtcacctctgatgagaaggtggactacgttcaggtggacaaggagaagacccaggccctgcagaacaccatgcaggagtggacagacgtgcggcagtcctcagagccttccaagggtgccaagctgtga

SEQ ID NO: 13050 - DNA, 809 bp, Artificial Sequence; identical to SEQ ID NO: 8505
  Synthetic polypeptide

SEQ ID NO: 13051 - DNA, 1987 bp, Artificial Sequence
  Synthetic polypeptide
tgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccagcaacagtatcaaagtgctctattttgggcagataaagtagcttcactctctcgtgaagaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtga

SEQ ID NO: 13052 - DNA, 1984 bp, Artificial Sequence
  Synthetic polypeptide
tgctggaggtggggctggtgggaggtggttggatcgtgcgggtggagtgctcgtgaagggtttagcaccatcctctacttgggactgtatagtgagtgagttcttgtgaggcctggttgttgaaaagtgtgtggcacctgccccctctctccctttctcttgttctggccagcaacagtatcaaagtgctctattttgggcagataaagtagcttcactctctcgtgaaccccaggacatctattggttggctcagtgtctttacctgacagcacaatatcacagagccgcccatgcacttcggtcacgaaaactggacaaattgtatgaagcatgtcgttaccttgcagctaggtgccattatgctgcaaaagagcaccagcaggcccttgatgttcttgacatggaagagcccatcaataaaagattatttgaaaaatacttgaaggacgaaagtggcttcaaagatccttccagcgactgggaaatgtcacagtcttcaataaagagttctatctgtcttctacgcgggaaaatctatgatgctctagataaccgaaccctggctacctacagctacaaagaagctttgaagcttgatgtctactgttttgaagcgttcgatcttttaacatcacatcacatgctgacagcacaagaagaaaaagaacttcttgaatcactaccccttagcaagctgtgtaatgaagaacaggaattgctgcgttttctatttgagaacaaattgaaaaaatataataagcctagtgaaacggtcatccctgaatctgtagatggcttgcaagagaatctggatgtggtagtgtctttagctgagagacattattataactgtgattttaaaatgtgctacaagcttacttctgtagtaatggagaaagatcctttccatgcaagttgtttacctgtacatatagggacgcttgtagagctgaataaagccaatgaacttttctatctttctcataaactggtggatttatatcctagtaatcctgtgtcttggtttgcagtgggatgttactatctcatggtcggtcataaaaatgaacatgccagaagatatctcagcaaagccacaacacttgagaaaacctatggacctgcatggatagcctatggacattcatttgcggtggagagtgagcacgaccaagcgatggctgcttacttcacagcagcacagctgatgaaagggtgtcatttgcctatgctgtatattggattagaatatggtttgaccaataactcaaaactagctgaaaggttcttcagccaagctctgagcattgcaccggaagacccttttgttatgcatgaggtcggcgtggttgcatttcagaatggagaatggaaaacagccgaaaaatggtttcttgatgctttggaaaaaattaaagcaattgggaacgaggtaacagttgacaaatgggaacctttgttgaacaacttggggcatgtctgcagaaaacttaaaaagtatgctgaggccttggattaccaccgtcaggcactggtgttgattcctcagaacgcatccacctactctgctattggatatatccacagtctgatgggcaactttgaaaatgctgtggactacttccacacagcccttggtcttaggcgagatgatacattttctgttacaatgcttggtcattgcatcgaaatgtacattggtgattctgaagcttatattggagcagacattaaagacaaattaaaatgttatgactttgatgtgcatacaatgaagacactaaaaaacattatttcacctccgtgggatttcagggaatttgaagtagaaaaacagactgcagaagaaacggggcttacgccattggaaacctcaaggaaaactccagattccagaccttccttggaagaaacctttgaaattgaaatgaatgaaagtgacatgatgttagagacatctatgtcagaccacagcacgtga

SEQ ID NO: 13053 - DNA, 3238 bp, Artificial Sequence; identical to SEQ ID NO: 8118
  Synthetic polypeptide

SEQ ID NO: 13054 - DNA, 1163 bp, Artificial Sequence; identical to SEQ ID NO: 7268
  Synthetic polypeptide

SEQ ID NO: 13055 - DNA, 893 bp, Artificial Sequence; identical to SEQ ID NO: 7269
  Synthetic polypeptide

SEQ ID NO: 13056 - DNA, 1235 bp, Artificial Sequence; identical to SEQ ID NO: 7270
  Synthetic polypeptide

SEQ ID NO: 13057 - DNA, 392 bp, Artificial Sequence; identical to SEQ ID NO: 7271
  Synthetic polypeptide

SEQ ID NO: 13058 - DNA, 902 bp, Artificial Sequence; identical to SEQ ID NO: 7272
  Synthetic polypeptide

SEQ ID NO: 13059 - DNA, 785 bp, Artificial Sequence; identical to SEQ ID NO: 7273
  Synthetic polypeptide

SEQ ID NO: 13060 - DNA, 2502 bp, Artificial Sequence
  Synthetic polypeptide
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatga

SEQ ID NO: 13061 - DNA, 390 bp, Artificial Sequence
  Synthetic polypeptide
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtgggtaatcctcccacttcttaa

SEQ ID NO: 13062 - DNA, 771 bp, Artificial Sequence
  Synthetic polypeptide
ggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaa

SEQ ID NO: 13063 - DNA, 657 bp, Artificial Sequence; identical to SEQ ID NO: 8366
  Synthetic polypeptide

SEQ ID NO: 13064 - DNA, 310 bp, Artificial Sequence; identical to SEQ ID NO: 8367
  Synthetic polypeptide

SEQ ID NO: 13065 - DNA, 718 bp, Artificial Sequence; identical to SEQ ID NO: 821
  Synthetic polypeptide

SEQ ID NO: 13066 - DNA, 809 bp, Artificial Sequence; identical to SEQ ID NO: 8643
  Synthetic polypeptide

SEQ ID NO: 13067 - DNA, 959 bp, Artificial Sequence; identical to SEQ ID NO: 7258
  Synthetic polypeptide

SEQ ID NO: 13068 - DNA, 649 bp, Artificial Sequence; identical to SEQ ID NO: 7259
  Synthetic polypeptide

SEQ ID NO: 13069 - DNA, 252 bp, Artificial Sequence; identical to SEQ ID NO: 8153
  Synthetic polypeptide

SEQ ID NO: 13070 - DNA, 561 bp, Artificial Sequence; identical to SEQ ID NO: 6592
  Synthetic polypeptide

SEQ ID NO: 13071 - DNA, 196 bp, Artificial Sequence; identical to SEQ ID NO: 6593
  Synthetic polypeptide

SEQ ID NO: 13072 - DNA, 423 bp, Artificial Sequence; identical to SEQ ID NO: 6594
  Synthetic polypeptide

SEQ ID NO: 13073 - DNA, 554 bp, Artificial Sequence; identical to SEQ ID NO: 12679
  Synthetic polypeptide

SEQ ID NO: 13074 - DNA, 473 bp, Artificial Sequence; identical to SEQ ID NO: 12680
  Synthetic polypeptide

SEQ ID NO: 13075 - DNA, 479 bp, Artificial Sequence; identical to SEQ ID NO: 12681
  Synthetic polypeptide

SEQ ID NO: 13076 - DNA, 676 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggacctcccagagttgcccaaacttctgacccagactcttcagaggcctgcgcggaggaagaggaagggctcatgcctcaaggtccccagctcctggacttcagcgtggacgaggtggccgagcagctga

SEQ ID NO: 13077 - DNA, 466 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctga

SEQ ID NO: 13078 - DNA, 2053 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctga

SEQ ID NO: 13079 - DNA, 2071 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacaggacctcccagagttgcccaaacttctgacccagactcttcagaggcctgcgcggaggaagaggaagggctcatgcctcaaggtccccagctcctggacttcagcgtggacgaggtggccgagcagctgaccctcatagacttggagctcttctccaaggtgaggctctacgagtgcttgggctccgtgtggtcgcagagggaccggccgggggctgcaggcgcctcccccactgtgcgcgccaccgtggcccagttcaacaccgtgaccggctgtgtgctgggttccgtgctcggagcaccgggcttggccgccccgcagagggcgcagcggctggagaagtggatccgcatcgcccagcgctgccgagaactgcggaacttctcctccttgcgcgccatcctgtccgccctgcaatctaaccccatctaccggctcaagcgcagctggggggcagtgagccgggaaccgctatctactttcaggaaactttcgcagattttctccgatgagaacaaccacctcagcagcagagagattcttttccaggaggaggccactgagggatcccaagaagaggacaacaccccaggcagcctgccctcaaaaccacccccaggccctgtcccctaccttggcaccttccttacggacctggttatgctggacacagccctgccggatatgttggagggggatctcattaactttgagaagaggaggaaggagtgggagatcctggcccgcatccagcagctgcagaggcgctgtcagagctacaccctgagcccccacccgcccatcctggctgccctgcatgcccagaaccagctcaccgaggagcagagctaccggctctcccgggtcattgagccaccagctgcctcctgccccagctccccacgcatccgacggcggatcagcctcaccaagcgtctcagtgcgaagcttgcccgagagaaaagctcatcacctagtgggagtcccggggacccctcatcccccacctccagcctctgcatctcccccagtgtgtccccagggtcacccccctcaagtcctagaagcagagatgctcctgctggcagtcccccggcctctccagggccccagggccccagcaccaagctgcccctgagcctggacctgcccagcccccggcccttcgctttgcctctgggcagccctcgaatccccctcccggcgcagcagagctcggaggcccgtgtcatccgcgtcagcatcgacaatgaccacgggaacctgtatcgaagcatcttgctgaccagtcaggacaaagcccccagcgtggtccggcgagccttgcagaagcacaatgtgccccagccctgggcctgtgactatcagctctttcaagtccttcctggggaccgggtgctcctgattcctgacaatgccaacgtcttctatgccatgagtccagtcgcccccagagacttcatgctgcggcggaaagaggggacccggaacactctgtctgtctccccaagctga

SEQ ID NO: 13080 - DNA, 558 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgagggctgtggtgtcagtgctgggctcctggctgcaggaccaccctcaggatttccgagacccccctgcccattcggacctgggcagtgtccgaacctttctgggctgggcggccccagggagtgctgaggctcaaaaagcagagaagcttctggaagattttttggaggaggctgagcgagagcaggaagaggagccgcctcaggtgtggacagg

SEQ ID NO: 13081 - DNA, 421 bp, Artificial Sequence
  Synthetic polypeptide
ggcggggcgaggtggctcacgcctgtaatcccagcactttgggaggccgaggcaagtggatcatcaggctcccagccccattgccaataccttcctccactatcgaaccagcaaggtgagggtgctgagggcagcgcgcctggagcggctggtgggagagttggtgtttggagaccgtgagcaggaccccagcttcatgcccgccttcctggccacctaccggacctttgtacccactgcctgcctgctgggctttctgctgccaccaatgccaccgcccccacctcccggggtagagatcaagaagacagcggtacaagatctgagcttcaacaagaacctgaggaccaccctcaggatttccgagacccccctgcccattcggacctgggcagtgtccgaacctttctgggctgggcgg

SEQ ID NO: 13082 - DNA, 1795 bp, Artificial Sequence; identical to SEQ ID NO: 879
  Synthetic polypeptide

SEQ ID NO: 13083 - DNA, 1171 bp, Artificial Sequence; identical to SEQ ID NO: 880
  Synthetic polypeptide

SEQ ID NO: 13084 - DNA, 701 bp, Artificial Sequence; identical to SEQ ID NO: 658
  Synthetic polypeptide

SEQ ID NO: 13085 - DNA, 139 bp, Artificial Sequence
  Synthetic polypeptide
ctgggtgcagtggctcatacctttaatcccagcactttgggaggccaagacctcccacagcccagtgtgccaggacgtgctgaaattcatcagtcagtggtgtggagggctccccagcaccagcttttcctttcagtag

SEQ ID NO: 13086 - DNA, 1283 bp, Artificial Sequence
  Synthetic polypeptide
tttaacgtatttaaagcactcagaacagcacctgacacatggtaaccacagtaaccaggatggccgagcctcgatttaacaacccctacttctggccccctcctcccaccatgcccagccagctggacaacctggttctgattaacaagatcaaggagcagctgatggccgagaagatcaggccgcctcacctgccgcccacgtcggcctcgtcgcagcagccgttgctagtgccgccggcacccgccgagagcagccaggccgtcatgtcgctgcccaagctgcagcaggtgccggggctgcatccacaggcggtgccgcagcccgacgtggcgctgcacgcacggccggccaccagcaccgtcacaggtctggggctgtccacccggaccccgtctgtgagcacttctgagtcaagcgcgggcgcgggcacgggcacgggtaccagcaccccgtccacacccaccaccaccagccagagccgcctcatcgcctcgtcccccaccctcatctcagggatcaccagcccccctctcctggactccatcaagacaatccagggccacggcctgcttggcccccccaagtccgaacgcggccgcaaaaagatcaaggcggagaacccggggggtccgcctgtccttgtagtcccctatcccatcctggcctcgggcgagactgccaaggagggcaagacgtacaggtgtaaggtatgcccactgacctttttcaccaagtcagagatgcagatccactccaagtcgcacacagaggccaagccccacaagtgcccgcactgctccaagtcctttgccaacgcctcctacctggcccagcacctgcgcatccacctgggcgtcaagccctaccactgctcctactgtgataagtccttccggcagctctcccacctccagcagcacaccagaatccacacaggcgacagaccctacaagtgcccacatcctggctgcgagaaggctttcactcagctctccaacctccagtctcaccagcgccagcacaacaaggacaagccctacaagtgtcccaactgctaccgggcctattcggactccgcttctttgcagatccacctctcggcccacgccatcaagcacgccaaggcctactgctgcagcatgtgtgggcgggcctacacctcggagacctacctgatgaagcacatgtccaaacacacggtggtggagcacctggtgagccatcactcgccccagaggacggagtcccccggcatcccggtgcgaatctctctcatctga

SEQ ID NO: 13087 - DNA, 1859 bp, Artificial Sequence
  Synthetic polypeptide
ggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcgagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13088 - DNA, 1979 bp, Artificial Sequence
  Synthetic polypeptide
ggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcgagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13089 - DNA, 636 bp, Artificial Sequence; identical to SEQ ID NO: 8339
  Synthetic polypeptide

SEQ ID NO: 13090 - DNA, 1418 bp, Artificial Sequence; identical to SEQ ID NO: 8618
  Synthetic polypeptide

SEQ ID NO: 13091 - DNA, 1595 bp, Artificial Sequence; identical to SEQ ID NO: 8619
  Synthetic polypeptide

SEQ ID NO: 13092 - DNA, 578 bp, Artificial Sequence; identical to SEQ ID NO: 9000
  Synthetic polypeptide

SEQ ID NO: 13093 - DNA, 590 bp, Artificial Sequence; identical to SEQ ID NO: 9001
  Synthetic polypeptide

SEQ ID NO: 13094 - DNA, 130 bp, Artificial Sequence; identical to SEQ ID NO: 9002
  Synthetic polypeptide

SEQ ID NO: 13095 - DNA, 228 bp, Artificial Sequence
  Synthetic polypeptide
ggccaggcgaggtggctcacacctgtaatcccagcactttgggaggccgaggcgggcagatcacaagggattggagtttggaatcctgccttcgatgtcaccccccacgacctcatcactggtggcatcatcacagaactgggggtctttgcccctgaggagctccggacagccctaaccaccaccatctcttccagggatggaaccctagatggaccccagatgtaa

SEQ ID NO: 13096 - DNA, 864 bp, Artificial Sequence; identical to SEQ ID NO: 6975
  Synthetic polypeptide

SEQ ID NO: 13097 - DNA, 471 bp, Artificial Sequence; identical to SEQ ID NO: 6976
  Synthetic polypeptide

SEQ ID NO: 13098 - DNA, 2282 bp, Artificial Sequence
  Synthetic polypeptide
gttcctcaaagactgtattggtgatcacgtaccgagaacccccaaatcctgagtatcaggaattccagaatcgtctgctgataagagcccgggaagactttggtgtggagctgggcccttccctgatgaacctcatcgctggctgcttctatgatgggatcctgctatatgctgaagtcctgaatgagacaatacaggaaggaggcacccgggaggatggacttcgaattgtggaaaagatgcagggacgaagatatcacggtgtaactgggctggttgtcatggacaagaacaatgaccgagagactgactttgtcctctgggccatgggagacctggattctggggactttcagcctgcagcccactactcgggagctgagaagcagatttggtggacgggacggcctattccctgggtgaagggggctcctccctcggacaatcccccctgtgcctttgacttggacgacccatcctgtgataaaactccactttcaaccctggcaattgtggctctgggcacaggaatcaccttcatcatgtttggtgtttccagcttcctaattttccgaaagctgatgctggagaaggagctggctagcatgttgtggcgtattcgctgggaagaactgcagtttggcaactcagagcgttatcacaaaggtgcaggcagtcgcctcacactgtcgctgcggggatccagttacggctcgctcatgacagcccatgggaaataccagatctttgccaacaccggtcacttcaagggaaatgttgtcgccatcaaacatgtgaataagaagcgcattgagctgacccggcaggttctgtttgaactcaaacatatgagagatgttcagttcaaccatctcactcgcttcattggcgcctgcatagaccctcccaacatttgcattgtcactgaatactgtcctcgtgggagtttacaggatattctagaaaatgacagcatcaacttggactggatgtttcgttattcactcattaatgaccttgttaagggcatggcctttctccacaacagcattatttcatcgcatgggagtctcaagtcctccaactgtgtggtggatagtcgttttgtgctcaaaatcacagactatggcctggccagcttccgatcaactgctgaacctgatgacagccatgccctctatgccaagaagctgtggactgccccagaactgctcagtgggaaccccttgccaaccacaggcatgcagaaggctgacgtctatagctttgggatcatcctgcaggagatagcacttcgcagtggtcctttctacttggagggcctggacctcagccccaaagagattgtccagaaggtacgaaatggtcagcggccatatttccggccaagcattgaccggacccaactgaatgaagagctagttttgctgatggagcgatgttgggctcaggacccagctgagcggccagactttggacagattaagggcttcattcggcgctttaacaaggagggtggcaccagcatattggacaacctcctgctgcgcatggaacagtatgccaataacttggagaagctggtggaggaacgcacacaggcctatctggaggaaaaacgcaaggctgaagctctgctctaccaaatcctaccccattcagtggcagagcagttaaaacggggagagactgtacaggctgaggcctttgacagtgttaccatctacttcagtgacattgttggcttcacagcattgtcagcagagagcacccccatgcaggtagtgacacttcttaatgacctgtatacctgctttgatgccataattgacaactttgatgtctacaaggtggagacgattggggatgcttacatggtggtatctggcctcccaggccgaaatggtcaacgccatgcaccagaaattgctcgtatggccctagcattactagatgcagtttcttcctttcgcatccgccaccgaccccatgaccagctgaggctacgcataggggtccatactgggccagtctgtgctggggttgttggcctgaagatgccccgttattgtctttttggagacacagtgaacactgcttctcgaatggagtctaatggtcaagcgctgaagatccatgtctcctctaccaccaaggatgccctagatgagctaggatgcttccagctagagcttcggggggatgtggaaatgaagggaaaaggaaagatgcgaacatactggctcttaggagagcggaaaggacctcctggactcctgtaa

SEQ ID NO: 13099 - DNA, 1314 bp, Artificial Sequence
  Synthetic polypeptide
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagcaacccaacgtggcctctgccaccaagaagttctcctacaagctggtgaagacgggcagcgtggtcctcacagccagcactgatctccgcggctatgtggtggggcaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtggtgccttccgcaccaccccaggaggaggctgaggctgaggctgcggctggcggcccccacttcttggaccccgtcttcctctccaccaagagccattcgcagcggcagcccctgctggccaccttgagttctgtgcctggtgcgccggagccctgccctcaggatggcagccctgcctcacacccgctgcaccctcccttgtgcatttcaacaggtgccactgtcccctactttgcagagggctccggggggccagtgcccactaccagcaccttgattcttcctccagagtacagttcttggggctacccctatgaggccccaccgtcttatgagcagagctgcggcggcgtggaacccagcctgacccctgagagctga

SEQ ID NO: 13100 - DNA, 543 bp, Artificial Sequence
  Synthetic polypeptide
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgagggatccagcctgcgcacacctgctaagcccctccctggccctccccccaagcaacccaacgtggcctctgccaccaagaagttctcctacaagctg

SEQ ID NO: 13101 - DNA, 384 bp, Artificial Sequence
  Synthetic polypeptide
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaagggtaagtttgggagccagttcccgagtggtgacccctgggggcagcccttggagtggggcctgtctgtcctgtcctccccctttcctagatctgcctcttggatctggcactggcccatcttgtcccagggttgtgggccctga

SEQ ID NO: 13102 - DNA, 826 bp, Artificial Sequence
  Synthetic polypeptide
gggggcggggggggaaggggttgggcgatgcaggtgttgggggccgggacagttgcgggggtaggcaggtaccgggaaggcgggagggcgggcaggttccggaggggcgcgacaggtgctgggacgcgagccatccgggtgacctgcataggttcctgcggggtctccaacaaggctaatgacacagcgtgggtagtggaggagggttacttcaacagttccctgtcgctggcagacaaggggagcctgcccgctggagagcacagcttccccttccagttcctgcttcctgccactgcacccacgtcctttgagggtcctttcgggaagatcgtgcaccaggtgagggccgccatccacacgccacggttttccaaggatcacaagtgcagcctcgtgttctatatcttgagccccttgaacctgaacagcatcccagacattgaggcactgcagctgcatgccgacgttgagaaccagtcaggcaaggacaccagccctgtggtggccagtctgctgcagaaagtgtcctataaggccaagcgctggatccacgacgtacggaccattgcggaggtggagggtgcgggcgtcaaggcctggcggcgggcgcagtggcacgagcagatcctggtgcctgccttgccccagtcggccctgccgggctgcagcctcatccacatcgactactacttacaggtctctctgaaggcgccggaagctactgtgaccctcccggtcttcattggcaatattgctgtgaaccatgccccagtgagcccccggccaggcctggggctgcctcctggggccccacccctggtgg

SEQ ID NO: 13103 - DNA, 200 bp, Artificial Sequence
  Synthetic polypeptide
gggcacagtggctcatgcctgtaatcccagcaccttgggaggccgagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtga

SEQ ID NO: 13104 - DNA, 213 bp, Artificial Sequence
  Synthetic polypeptide
gggcacagtggctcatgcctgtaatcccagcaccttgggaggccgagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtga

SEQ ID NO: 13105 - DNA, 646 bp, Artificial Sequence
  Synthetic polypeptide
gggggaggagccaagatggccgaataggaacagctccggtctacagctcccagcgtgagcgacgcagaagacgggtgatttctgcatttccatctgagctgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtga

SEQ ID NO: 13106 - DNA, 779 bp, Artificial Sequence
  Synthetic polypeptide
ggaggcaggtgtgtggggggaagcgggtgtgtgtctgaggaagcgggtgtgtgtggggggaagcgggtgtgtggaggcgggcgtgtgggggaggcgggtgtgtgtgtgagaggaaggtgtgtgggaggaggcagatttgtggggggaggcgggcgtgtgggggaggcgggtgtgaggcgggtgtccgggaggcagccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13107 - DNA, 943 bp, Artificial Sequence; identical to SEQ ID NO: 6540
  Synthetic polypeptide

SEQ ID NO: 13108 - DNA, 719 bp, Artificial Sequence
  Synthetic polypeptide
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtga

SEQ ID NO: 13109 - DNA, 368 bp, Artificial Sequence
  Synthetic polypeptide
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaaggacatttga

SEQ ID NO: 13110 - DNA, 686 bp, Artificial Sequence
  Synthetic polypeptide
tattttgggccaaattgtgtctcccgacccctgcaaattcatatgttgaagccctggctccccagtacctcagaatgtgactgtatttggagagagggcctttaaagagctgatttaacttaacatgaggccaattagggtgggctctgatccaatctgattaatgttcttatcagaagaggaaatttggacacacagagacaccagagcagagggaagaccttgtgaagacacagggagaatgtggccatctttgagttaagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtga

SEQ ID NO: 13111 - DNA, 1912 bp, Artificial Sequence; identical to SEQ ID NO: 8999
  Synthetic polypeptide

SEQ ID NO: 13112 - DNA, 999 bp, Artificial Sequence; identical to SEQ ID NO: 7471
  Synthetic polypeptide

SEQ ID NO: 13113 - DNA, 2825 bp, Artificial Sequence; identical to SEQ ID NO: 6727
  Synthetic polypeptide

SEQ ID NO: 13114 - DNA, 1188 bp, Artificial Sequence; identical to SEQ ID NO: 12282
  Synthetic polypeptide

SEQ ID NO: 13115 - DNA, 1131 bp, Artificial Sequence; identical to SEQ ID NO: 12283
  Synthetic polypeptide

SEQ ID NO: 13116 - DNA, 1263 bp, Artificial Sequence; identical to SEQ ID NO: 12284
  Synthetic polypeptide

SEQ ID NO: 13117 - DNA, 894 bp, Artificial Sequence; identical to SEQ ID NO: 12285
  Synthetic polypeptide

SEQ ID NO: 13118 - DNA, 807 bp, Artificial Sequence; identical to SEQ ID NO: 12286
  Synthetic polypeptide

SEQ ID NO: 13119 - DNA, 697 bp, Artificial Sequence; identical to SEQ ID NO: 12287
  Synthetic polypeptide

SEQ ID NO: 13120 - DNA, 765 bp, Artificial Sequence; identical to SEQ ID NO: 12288
  Synthetic polypeptide

SEQ ID NO: 13121 - DNA, 365 bp, Artificial Sequence; identical to SEQ ID NO: 12289
  Synthetic polypeptide

SEQ ID NO: 13122 - DNA, 476 bp, Artificial Sequence; identical to SEQ ID NO: 12290
  Synthetic polypeptide

SEQ ID NO: 13123 - DNA, 113 bp, Artificial Sequence; identical to SEQ ID NO: 12291
  Synthetic polypeptide

SEQ ID NO: 13124 - DNA, 211 bp, Artificial Sequence; identical to SEQ ID NO: 12292
  Synthetic polypeptide

SEQ ID NO: 13125 - DNA, 305 bp, Artificial Sequence
  Synthetic polypeptide
ttatggttttgaagcatatttagtggtcgggaagagtgctcatgatgcgaagctaactgaactatatatacagaatgatccagactttgaaaggaaaaactaaagaaatacatctacatattaagtagtgcatggccccagatgagaccaccctaaaggagctggccgagaccctgcaacagaagaacattgaccacatgctgtggcttgagcaaccagagaatatcgccacttgtattgctctccggccctaccccaaggaagaagtgggccagtatttgaagaagttccgattgttcaagtaa

SEQ ID NO: 13126 - DNA, 1737 bp, Artificial Sequence; identical to SEQ ID NO: 905
  Synthetic polypeptide

SEQ ID NO: 13127 - DNA, 284 bp, Artificial Sequence; identical to SEQ ID NO: 906
  Synthetic polypeptide

SEQ ID NO: 13128 - DNA, 856 bp, Artificial Sequence; identical to SEQ ID NO: 907
  Synthetic polypeptide

SEQ ID NO: 13129 - DNA, 802 bp, Artificial Sequence; identical to SEQ ID NO: 908
  Synthetic polypeptide

SEQ ID NO: 13130 - DNA, 561 bp, Artificial Sequence; identical to SEQ ID NO: 909
  Synthetic polypeptide

SEQ ID NO: 13131 - DNA, 582 bp, Artificial Sequence; identical to SEQ ID NO: 910
  Synthetic polypeptide

SEQ ID NO: 13132 - DNA, 135 bp, Artificial Sequence
  Synthetic polypeptide
ggccatgcgcggtggctcacgcctgtaatcccagcactttgggaggccaagccgtttccctggggagatggtaaccatactctattccataaccctcatgtgaatccacttccaactggctacgaagatgaataa

SEQ ID NO: 13133 - DNA, 770 bp, Artificial Sequence
  Synthetic polypeptide
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttccacatgtttgacgtgggtggccagcgcgatgaacgccgcaagtggatccagtgcttcaacgatgtgactgccatcatcttcgtggtggccagcagcagctacaacatggtcatccgggaggacaaccagaccaaccgcctgcaggaggctctgaacctcttcaagagcatctggaacaacagatggctgcgcaccatctctgtgatcctgttcctcaacaagcaagatctgctcgctgagaaagtccttgctgggaaatcgaagattgaggactactttccagaatttgctcgctacactactcctgaggatgctactcccgagcccggagaggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 13134 - DNA, 137 bp, Artificial Sequence
  Synthetic polypeptide
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtg

SEQ ID NO: 13135 - DNA, 115 bp, Artificial Sequence
  Synthetic polypeptide
ccctccccttcccgcccgaattctatgagcatgccaaggctctgtgggaggatgaaggagtgcgtgcctgctacgaacgctccaacgagtaccagctgattgactgtgcccagta

SEQ ID NO: 13136 - DNA, 244 bp, Artificial Sequence
  Synthetic polypeptide
ccctccccttcccgcccgaattctatgagcatgccaaggctctgtgggaggatgaaggagtgcgtgcctgctacgaacgctccaacgagtaccagctgattgactgtgcccagtacttcctggacaagatcgacgtgatcaagcaggctgactatgtgccgagcgatcaggacctgcttcgctgccgtgtcctgacttctggaatctttgagaccaagttccaggtggacaaagtcaacttcca

SEQ ID NO: 13137 - DNA, 123 bp, Artificial Sequence
  Synthetic polypeptide
ccctccccttcccgcccgaattctatgagcatgccaaggctctgtgggaggatgaaggagtgcgtgcctgctacgaacgctccaacgagtaccagctgattgactgtgcccagtacttcctgg

SEQ ID NO: 13138 - DNA, 966 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13139 - DNA, 1167 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13140 - DNA, 1143 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13141 - DNA, 774 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtga

SEQ ID NO: 13142 - DNA, 471 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggtgagtgcttgccgggccggccgcgcccggggagggctgggggcgctcggcgcggccctgaccgtgccccgaccctcctcggccccaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactga

SEQ ID NO: 13143 - DNA, 1182 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctga

SEQ ID NO: 13144 - DNA, 649 bp, Artificial Sequence
  Synthetic polypeptide
ccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccggccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtc

SEQ ID NO: 13145 - DNA, 953 bp, Artificial Sequence
  Synthetic polypeptide
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13146 - DNA, 362 bp, Artificial Sequence
  Synthetic polypeptide
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaaggggtaa

SEQ ID NO: 13147 - DNA, 962 bp, Artificial Sequence
  Synthetic polypeptide
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggagttgctgctgggagctccagctcagtgaaatggacagaagggcagagcaaccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13148 - DNA, 911 bp, Artificial Sequence
  Synthetic polypeptide
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtaaaacaagtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13149 - DNA, 902 bp, Artificial Sequence
  Synthetic polypeptide
cgaggcggttggatcacctgaggtcaggagtttgagaccagcctggccaacacggttacagcacggtcaccttcgacgggacgcccagctacggtcacacgccctcgcaccatgcggcgcagttccccaaccactcattcaagcatgaggatcccatgggccagcagggctcgctgggtgagcagcagtactcggtgccgcccccggtctatggctgccacacccccaccgacagctgcaccggcagccaggctttgctgctgaggacgccctacagcagtgacaatttataccaaatgacatcccagcttgaatgcatgacctggaatcagatgaacttaggagccaccttaaagggccacagcacagggtacgagagcgataaccacacaacgcccatcctctgcggagcccaatacagaatacacacgcacggtgtcttcagaggcattcaggatgtgcgacgtgtgcctggagtagccccgactcttgtacggtcggcatctgagaccagtgagaaacgccccttcatgtgtgcttacccaggctgcaataagagatattttaagctgtcccacttacagatgcacagcaggaagcacactggtgagaaaccataccagtgtgacttcaaggactgtgaacgaaggttttctcgttcagaccagctcaaaagacaccaaaggagacatacaggtgtgaaaccattccagtgtaaaacttgtcagcgaaagttctcccggtccgaccacctgaagacccacaccaggactcatacaggtgaaaagcccttcagctgtcggtggccaagttgtcagaaaaagtttgcccggtcagatgaattagtccgccatcacaacatgcatcagagaaacatgaccaaactccagctggcgctttga

SEQ ID NO: 13150 - DNA, 809 bp, Artificial Sequence; identical to SEQ ID NO: 8613
  Synthetic polypeptide

SEQ ID NO: 13151 - DNA, 512 bp, Artificial Sequence
  Synthetic polypeptide
gctgggcaccggggctcacacctgtaatcccagcactttgggaggccaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaa

SEQ ID NO: 13152 - DNA, 857 bp, Artificial Sequence
  Synthetic polypeptide
gctgggcaccggggctcacacctgtaatcccagcactttgggaggccaagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaa

SEQ ID NO: 13153 - DNA, 1448 bp, Artificial Sequence
  Synthetic polypeptide
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggaggtgaggagcgtctctgcccggccgccccgtctgagaagtgaggagaccctccgcccggcagccgccccgtctgagaagttaggagcctctccgcccggcagccgccccgtctgggaagtgaggagcgtctctgcccggcagccaccccgtccgggagggaggtggggggggtcagccccccgcccggccagccgccccgtccgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13154 - DNA, 864 bp, Artificial Sequence; identical to SEQ ID NO: 6737
  Synthetic polypeptide

SEQ ID NO: 13155 - DNA, 2662 bp, Artificial Sequence; identical to SEQ ID NO: 8473
  Synthetic polypeptide

SEQ ID NO: 13156 - DNA, 1822 bp, Artificial Sequence; identical to SEQ ID NO: 8474
  Synthetic polypeptide

SEQ ID NO: 13157 - DNA, 610 bp, Artificial Sequence
  Synthetic polypeptide
ggaggcaggtgtgtggggggaagcggccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13158 - DNA, 796 bp, Artificial Sequence; identical to SEQ ID NO: 8652
  Synthetic polypeptide

SEQ ID NO: 13159 - DNA, 383 bp, Artificial Sequence; identical to SEQ ID NO: 8653
  Synthetic polypeptide

SEQ ID NO: 13160 - DNA, 155 bp, Artificial Sequence; identical to SEQ ID NO: 8654
  Synthetic polypeptide

SEQ ID NO: 13161 - DNA, 118 bp, Artificial Sequence; identical to SEQ ID NO: 8655
  Synthetic polypeptide

SEQ ID NO: 13162 - DNA, 193 bp, Artificial Sequence; identical to SEQ ID NO: 8656
  Synthetic polypeptide

SEQ ID NO: 13163 - DNA, 103 bp, Artificial Sequence; identical to SEQ ID NO: 8657
  Synthetic polypeptide

SEQ ID NO: 13164 - DNA, 230 bp, Artificial Sequence; identical to SEQ ID NO: 8658
  Synthetic polypeptide

SEQ ID NO: 13165 - DNA, 279 bp, Artificial Sequence; identical to SEQ ID NO: 8659
  Synthetic polypeptide

SEQ ID NO: 13166 - DNA, 2887 bp, Artificial Sequence; identical to SEQ ID NO: 8311
  Synthetic polypeptide

SEQ ID NO: 13167 - DNA, 2941 bp, Artificial Sequence; identical to SEQ ID NO: 8312
  Synthetic polypeptide

SEQ ID NO: 13168 - DNA, 2980 bp, Artificial Sequence; identical to SEQ ID NO: 8313
  Synthetic polypeptide

SEQ ID NO: 13169 - DNA, 2887 bp, Artificial Sequence; identical to SEQ ID NO: 8314
  Synthetic polypeptide

SEQ ID NO: 13170 - DNA, 3046 bp, Artificial Sequence; identical to SEQ ID NO: 8315
  Synthetic polypeptide

SEQ ID NO: 13171 - DNA, 2959 bp, Artificial Sequence; identical to SEQ ID NO: 8316
  Synthetic polypeptide

SEQ ID NO: 13172 - DNA, 2941 bp, Artificial Sequence; identical to SEQ ID NO: 8317
  Synthetic polypeptide

SEQ ID NO: 13173 - DNA, 940 bp, Artificial Sequence; identical to SEQ ID NO: 8318
  Synthetic polypeptide

SEQ ID NO: 13174 - DNA, 796 bp, Artificial Sequence; identical to SEQ ID NO: 8676
  Synthetic polypeptide

SEQ ID NO: 13175 - DNA, 272 bp, Artificial Sequence; identical to SEQ ID NO: 8677
  Synthetic polypeptide

SEQ ID NO: 13176 - DNA, 226 bp, Artificial Sequence; identical to SEQ ID NO: 8678
  Synthetic polypeptide

SEQ ID NO: 13177 - DNA, 175 bp, Artificial Sequence; identical to SEQ ID NO: 8679
  Synthetic polypeptide

SEQ ID NO: 13178 - DNA, 886 bp, Artificial Sequence
  Synthetic polypeptide
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13179 - DNA, 901 bp, Artificial Sequence
  Synthetic polypeptide
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtacatgctgtggagatccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13180 - DNA, 901 bp, Artificial Sequence
  Synthetic polypeptide
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccagggggaggaagtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13181 - DNA, 931 bp, Artificial Sequence
  Synthetic polypeptide
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgggtgtgtgtgcaggttaaagatgatagcacggagcctggcttgtgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctctatgagctctcgcccatgatggtgaagctgacggagaagcacaggtccttcacccacttcctgacaggtgtgtgcgccatcattgggggcatgttcacagtggctggactcatcgattcgctcatctaccactcagcacgagccatccagaagaaaattgatctagggaagacaacgtag

SEQ ID NO: 13182 - DNA, 707 bp, Artificial Sequence
  Synthetic polypeptide
ggccaggcatggtggctcacgcctgtagtcccagcacttttggaggctgaggcagttggatcacctgaagtcaggagttcaagaccagcctggccaacatgagcttgggaaagtcgaggtgacggtgtttgaccctgactccctggaccctgatcgctgtgagagctgctatggtgctgaggcagaagatatcaagtgctgtaacacctgtgaagatgtgcgggaggcatatcgccgtagaggctgggccttcaagaacccagatactattgagcagtgccggcgagagggcttcagccagaagatgcaggagcagaagaatgaaggctgccaggtgtatggcttcttggaagtcaataaggtggccggaaacttccactttgcccctgggaagagcttccagcagtcccatgtgcacgtccatgacttgcagagctttggccttgacaacatcaacatgacccactacatccagcacctgtcatttggggaggactatccaggcattgtgaaccccctggaccacaccaatgtcactgcgccccaagcctccatgatgttccagtactttgtgaaggtggtgcccactgtgtacatgaaggtggacggagaggtactgaggacaaatcagttctctgtgaccagacatgagaaggttgccaatgggctgttgggcgaccaaggccttcccggagtcttcgtcctct

SEQ ID NO: 13183 - DNA, 591 bp, Artificial Sequence
  Synthetic polypeptide
tgctttggttcgaatgtgttcctccatgttgccagtgggatggtagtaaaaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttga

SEQ ID NO: 13184 - DNA, 549 bp, Artificial Sequence
  Synthetic polypeptide
tgctttggttcgaatgtgttcctccatgttgccagtgggatggtagtaaaaggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtag

SEQ ID NO: 13185 - DNA, 811 bp, Artificial Sequence; identical to SEQ ID NO: 7106
  Synthetic polypeptide

SEQ ID NO: 13186 - DNA, 650 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactga

SEQ ID NO: 13187 - DNA, 521 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 13188 - DNA, 524 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 13189 - DNA, 996 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 13190 - DNA, 717 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 13191 - DNA, 404 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatga

SEQ ID NO: 13192 - DNA, 404 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtga

SEQ ID NO: 13193 - DNA, 395 bp, Artificial Sequence
  Synthetic polypeptide
ggccgggtgcggtggctgacacctgtaatcccagcactttgggagcccgaggcgggcggatcacctgaggtcgggagttcaagaccagcctgaccaacatggagaaaccctgtctctactaaaaatacaaaattagccgggcgtggtggcagatgcctgtaatcccagctactcagaaggctgaggcaggagaatcacttgaacctgggaagtggaggttgaggatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctag

SEQ ID NO: 13194 - DNA, 772 bp, Artificial Sequence
  Synthetic polypeptide
ggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcggacggaggctccctcggccacgggccaggcctcctcgctgctggggggcaggctcctggggcagagtgccgcgagctgccatcacgcctacatcgtgctctgcattgagaacagcttcatgactgcctccaagtag

SEQ ID NO: 13195 - DNA, 637 bp, Artificial Sequence
  Synthetic polypeptide
ggacaatgaagtggccgccttgcagccccccgtggtgcagctgcacgacagcaacccctacccgcggcgggagcacccccaccccaccgcgcggccctggcgggcagatgacatcctggccagcccccctcgcctgcccgagccccagccctaccccggagccccgcaccacagctcctacgtgcacctgcggccggcgcgacccacaagcccacccgcccacagccaccgcgacttccagccggtgctccacctggttgcgctcaacagccccctgtcaggcggcatgcggggcatccgcggggccgacttccagtgcttccagcaggcgcgggccgtggggctggcgggcaccttccgcgccttcctgtcctcgcgcctgcaggacctgtacagcatcgtgcgccgtgccgaccgcgcagccgtgcccatcgtcaacctcaaggacgagctgctgtttcccagctgggaggctctgttctcaggctctgagggtccgctgaagcccggggcacgcatcttctcctttgacggcaaggacgtcctgaggcaccccacctggccccagaagagcgtgtggcatggctcggaccccaacgggcgcaggctgaccgagagctactgtgagacgtggcgg

SEQ ID NO: 13196 - DNA, 83 bp, Artificial Sequence; identical to SEQ ID NO: 10925
  Synthetic polypeptide

SEQ ID NO: 13197 - DNA, 555 bp, Artificial Sequence; identical to SEQ ID NO: 10926
  Synthetic polypeptide

SEQ ID NO: 13198 - DNA, 650 bp, Artificial Sequence
  Synthetic polypeptide
ggaggcaggtgtgtggggggaagcgggtgtgtgtctgaggaagcgggtgtgtgtggggggaagcggccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctag

SEQ ID NO: 13199 - DNA, 1084 bp, Artificial Sequence; identical to SEQ ID NO: 580
  Synthetic polypeptide

SEQ ID NO: 13200 - DNA, 308 bp, Artificial Sequence; identical to SEQ ID NO: 7506
  Synthetic polypeptide

SEQ ID NO: 13201 - DNA, 423 bp, Artificial Sequence; identical to SEQ ID NO: 7507
  Synthetic polypeptide

SEQ ID NO: 13202 - DNA, 369 bp, Artificial Sequence; identical to SEQ ID NO: 7508
  Synthetic polypeptide

SEQ ID NO: 13203 - DNA, 456 bp, Artificial Sequence; identical to SEQ ID NO: 7509
  Synthetic polypeptide

SEQ ID NO: 13204 - DNA, 1052 bp, Artificial Sequence; identical to SEQ ID NO: 447
  Synthetic polypeptide

SEQ ID NO: 13205 - DNA, 1118 bp, Artificial Sequence; identical to SEQ ID NO: 448
  Synthetic polypeptide

SEQ ID NO: 13206 - DNA, 309 bp, Artificial Sequence; identical to SEQ ID NO: 8320
  Synthetic polypeptide

SEQ ID NO: 13207 - DNA, 636 bp, Artificial Sequence; identical to SEQ ID NO: 817
  Synthetic polypeptide

SEQ ID NO: 13208 - DNA, 582 bp, Artificial Sequence; identical to SEQ ID NO: 819
  Synthetic polypeptide

SEQ ID NO: 13209 - DNA, 3241 bp, Artificial Sequence
  Synthetic polypeptide
agctgaaaccctcaaggcttatggggcccagcctgacctgtcgcctgctctcctctgattccgtctcctaccattctttccattgctcaatcctccagccatactggcctcctctctcttccttgaaatccaccactcctgcctcaaggcctttccacttgctgtagcctgtctagaagactcttccccaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcggaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctga

SEQ ID NO: 13210 - DNA, 565 bp, Artificial Sequence
  Synthetic polypeptide
agctgaaaccctcaaggcttatggggcccagcctgacctgtcgcctgctctcctctgattccgtctcctaccattctttccattgctcaatcctccagccatactggcctcctctctcttccttgaaatccaccactcctgcctcaaggcctttccacttgctgtagcctgtctagaagactcttccccaggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaagactcacagaaagagctggcctga

SEQ ID NO: 13211 - DNA, 721 bp, Artificial Sequence; identical to SEQ ID NO: 10080
  Synthetic polypeptide

SEQ ID NO: 13212 - DNA, 706 bp, Artificial Sequence; identical to SEQ ID NO: 10081
  Synthetic polypeptide

SEQ ID NO: 13213 - DNA, 526 bp, Artificial Sequence; identical to SEQ ID NO: 10082
  Synthetic polypeptide

SEQ ID NO: 13214 - DNA, 487 bp, Artificial Sequence; identical to SEQ ID NO: 10083
  Synthetic polypeptide

SEQ ID NO: 13215 - DNA, 667 bp, Artificial Sequence; identical to SEQ ID NO: 10084
  Synthetic polypeptide

SEQ ID NO: 13216 - DNA, 592 bp, Artificial Sequence; identical to SEQ ID NO: 10085
  Synthetic polypeptide

SEQ ID NO: 13217 - DNA, 1107 bp, Artificial Sequence
  Synthetic polypeptide
ggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataa

SEQ ID NO: 13218 - DNA, 760 bp, Artificial Sequence
  Synthetic polypeptide
ggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctgggg

SEQ ID NO: 13219 - DNA, 1681 bp, Artificial Sequence; identical to SEQ ID NO: 8523
  Synthetic polypeptide

SEQ ID NO: 13220 - DNA, 226 bp, Artificial Sequence
  Synthetic polypeptide
gatcaatgaagactaaatataaaaaacattttcttgaatggcatgctagtagcagtgagcaaagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaa

SEQ ID NO: 13221 - DNA, 129 bp, Artificial Sequence
  Synthetic polypeptide
gatcaatgaagactaaatataaaaaacattttcttgaatggcatgctagtagcagtgagcaaagcctgaggttgcagactggtctgaaggtgtacaggtgccctctgtgcctattcagcaattccctac

SEQ ID NO: 13222 - DNA, 1739 bp, Artificial Sequence
  Synthetic polypeptide
gccgggcgtggtggcttacgcctgtaatcccagcactttgggaggccaaggcgggcggatcaggagttcaagaccagcctggccaacatggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactggagcggggtttggaggaccacgagtccgtggtggaagtgcaggctgcctggcccgtgggcggagatagccgcttcgtcttccggaaaaacttcgccaagtacgaactgttcaagagctccccacactccctgttcccagaaaaaatggtctccagctgtctcgatgcacacactggtatatcccatgaagacctcatccagaacttcctgaatgctggcagctttcctgagatccagggctttctgcagctgcggggttcaggacggaagctttggaaacgctttttctgcttcttgcgccgatctggcctctattactccaccaagggcacctctaaggatccgaggcacctgcagtacgtggcagatgtgaacgagtccaacgtgtacgtggtgacgcagggccgcaagctctacgggatgcccactgacttcggtttctgtgtcaagcccaacaagcttcgaaatggccacaaggggcttcggatcttctgcagtgaagatgagcagagccgcacctgctggctggctgccttccgcctcttcaagtacggggtgcagctgtacaagaattaccagcaggcacagtctcgccatctgcatccatcttgtttgggctccccacccttgagaagtgcctcagataataccctggtggccatggacttctctggccatgctgggcgtgtcattgagaacccccgggaggctctgagtgtggccctggaggaggcccaggcctggaggaagaagacaaaccaccgcctcagcctgcccatgccagcctccggcacgagcctcagtgcagccatccaccgcacccaactctggttccacgggcgcatttcccgtgaggagagccagcggcttattggacagcagggcttggtagacggcctgttcctggtccgggagagtcagcggaacccccagggctttgtcctctctttgtgccacctgcagaaagtgaagcattatctcatcctgccgagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctga

SEQ ID NO: 13223 - DNA, 643 bp, Artificial Sequence
  Synthetic polypeptide
ctgcctcatcttagcagtaattaataatcactcatggatccatgaactaaggagctggagatagcctcagaacagctcattcagagatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 13224 - DNA, 976 bp, Artificial Sequence
  Synthetic polypeptide
ttaatcccccgaagcctccgtttccacatgttcttgacaagatagacttttctgagtcttttggggactaaatgaaacagtggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagagaacctggagtactgtatcatggtcattggggtccccaacgtgggcaagtcctccctcatcaactccctccggaggcagcacctcaggaaagggaaagccaccagggtgggtggcgagcctgggatcaccagagctgtgatgtccaaaattcaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctga

SEQ ID NO: 13225 - DNA, 823 bp, Artificial Sequence
  Synthetic polypeptide
ttaatcccccgaagcctccgtttccacatgttcttgacaagatagacttttctgagtcttttggggactaaatgaaacagtggggctgaagaagatgcagagcagcctgaagctggtggactgtatcatcgaggtccacgatgcccggatcccactttcaggccgcaaccctctgtttcaggaaacccttgggcttaagcctcacttgctggtcctcaacaagatggacttggcggatcttacagagcagcagaaaattatgcaacacttagaaggagaaggcctaaaaaatgtcatttttaccaactgtgtaaaggatgaaaatgtcaagcagatcatcccgatggtcactgaactgattgggagaagccaccgctaccaccgaaaagaggtctctgagcggcccctgatgttcctgttggacactcctggcgtgctggctcctcggattgaaagtgtggagacaggcctgaagctggccctgtgtggaacggtgctggaccacctggtcggggaggagaccatggctgactacctgctgtacaccctcaacaaacaccagcgctttgggtacgtgcagcactacggcctgggcagtgcctgtgacaacgtagagcgcgtgctgaagagtgtggctgtgaagctggggaagacgcagaaggtgaaggtgctcacgggcacgggtaacgtgaacattattcagcctaactatcctgcggcagcccgtgacttcctgcagactttccgccgtgggctgctgggttccgtgatgctggacctcgacgtcctgcggggccaccccccggctgagactttgccctga

SEQ ID NO: 13226 - DNA, 682 bp, Artificial Sequence
  Synthetic polypeptide
atgcctgtaatcccagcactttgggaggctgaggccagaggatcacttgaagccaggagtttgagaccagcctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaaggccattatgctgtgatgaacaaccccaccagacagcctttggccctaaacgttgcatacaggcgctgcttgcagattctggctgcaggactgttcctgccaggttcagtgggtatcactgacccctgtgagagtggcaactttagagtacacacagtcatgaccctagaacagcaggacatggtctgctatacagctcagactctcgtccgaatcctctcacatggtggctttaggaagatccttggccaggagggtgatgccagctatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtga

SEQ ID NO: 13227 - DNA, 854 bp, Artificial Sequence; identical to SEQ ID NO: 6577
  Synthetic polypeptide

SEQ ID NO: 13228 - DNA, 1100 bp, Artificial Sequence
  Synthetic polypeptide
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaaggtggcttcacaataacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13229 - DNA, 183 bp, Artificial Sequence
  Synthetic polypeptide
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataa

SEQ ID NO: 13230 - DNA, 1184 bp, Artificial Sequence
  Synthetic polypeptide
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaaggtggcttcacaataacaggaaaatacctgtttggccaacctgtcttcaggaaggttcatgctagagaacatccgattctctctactgtaatcaccattgcagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13231 - DNA, 1100 bp, Artificial Sequence
  Synthetic polypeptide
gaggagccaagatggccgaataggaacagctccggtctacagctcccagcgtgagcgacgcagaagacgggcgatttctgcatttccatctgaggaagatcattaccattagaatatttgaccgtgaggaatatgagaaagagtgcagtttctcccttgtgcttgaggaaccaaaatggataagaagaggaatgaaagaaggattctgtttcacagacgaatatgatgacaagcagccactgaccagcaaagaggaagaggagaggcgcattgcagaaatggggcgccccatcctgggagagcacaccaagttggaagtgatcattgaagaatcctatgaattcaagagtactgtggacaaactcattaagaagacaaacctggcccttgtggttgggactaacagctggagagaacagttcattgaagctatcactgtcagtgctggggaagatgatgacgacgatgaatgtggggaagagaagctgccctcctgtttcgattacgtgatgcactttctgactgtgttctggaaggtcctgtttgccttcgtcccccctactgaatactggaatggctgggcgtgtttcattgtctccatcctcatgattggcctactgacagctttcattggagacctggcttcccactttggctgcaccattggcctgaaagattctgtgactgcagtcgtgttcgtcgcacttggaacatcagtgccagacacatttgccagcaaagtggcagccacccaggaccagtatgcagacgcctccataggtaacgtcacgggcagcaacgcggtgaatgtcttcctgggaatcggtgtggcctggtccatcgctgccatctaccacgcagccaatggggaacagttcaaagtgtcccctggcacactagctttctctgtcactctcttcaccatttttgctttcatcaatgtgggggtgctgctgtatcggcggaggccagaaatcggaggtgagctgggtgggccccggactgccaagctcctcacatcctgcctctttgtgctcctatggctcttgtacattttcttctcctccctggaggcctactgccacataaaaggcttctaa

SEQ ID NO: 13232 - DNA, 2651 bp, Artificial Sequence
  Synthetic polypeptide
gctggtcacagtggctcatgcctgtaatcccagcactttgggaggccaaggcaggcggattgcttgagcccatgagatggagatgagcctggacaacatgggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtacatgatgatgcgggactgctggcatgcagtgccctcacagagacccaccttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctga

SEQ ID NO: 13233 - DNA, 286 bp, Artificial Sequence
  Synthetic polypeptide
cactgcgcccagcctccagatgcttttaaagaacccagactcccatggttatgacaaggaccccgttttggacgtctggaacatgcgacttgtcttcttctttggcgtctccatcatcctggtccttggcagcacctttgtggcctatctgcctgactacaggatgaaagagtggtcccgccgcgaagctgagaggcttgtgaaataccgagaggccaatggccttcccatcatggaatccaactgcttcgaccccagcaagatccagctgccagaggatgagtga

SEQ ID NO: 13234 - DNA, 316 bp, Artificial Sequence
  Synthetic polypeptide
cactgcgcccagcctccagatgcttttaaagaacccagactcccatggttatgacaaggaccccgttttggacgtctggaacatgcgacttgtcttcttctttggcgtctccatcatcctggtccttggcagcacctttgtggcctatctgcctgactacaggtgcacagggtgtccaagagcgtgggatgggatgaaagagtggtcccgccgcgaagctgagaggcttgtgaaataccgagaggccaatggccttcccatcatggaatccaactgcttcgaccccagcaagatccagctgccagaggatgagtga

SEQ ID NO: 13235 - DNA, 828 bp, Artificial Sequence
  Synthetic polypeptide
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaaggtga

SEQ ID NO: 13236 - DNA, 939 bp, Artificial Sequence
  Synthetic polypeptide
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagctcagcctcacaggccaaagcatcagcaccagaacgcacacccagcccagccccaaagagaaagaagagacagcaaagagccgcagccggtgcttgcacaccgccttgcacatag

SEQ ID NO: 13237 - DNA, 951 bp, Artificial Sequence
  Synthetic polypeptide
tccactcctttctcttcagcccctcggacactgcctagcctcgatgacttacgagccctcaaggggaagcattttctcctggaccccttgatgccggagctgctggtgtttcccgcccagacagatctgcatgaacacccactgtaccgggccggacacctcattctgcaggacagggccagctgtctcccagccatgctgctggaccccccgccaggctcccatgtcatcgatgcctgtgccgccccaggcaataagaccagtcacttggctgctcttctgaagaaccaagggaagatctttgcctttgacctggatgccaagcggctggcatccatggccacgctgctggcccgggctggcgtctcttgctgtgaactggctgaggaggacttcctggcggtctccccctcggatccacgctaccatgaggtccactacatcctgctggatccttcctgcagtggctcgggtatgccgagcagacagctggaggagcccggggcaggcacacctagcccggtgcgtctgcatgccctggcagggttccagcagcgagccctgtgccacgcgctcactttcccttccctgcagcggctcgtctactccacgtgctccctctgccaggaggagaatgaagacgtggtgcgagatgcgctgcagcagaacccgggcgccttcaggctagctcccgccctgcctgcctggccccaccgaggcctgagcacgttcccgggtgccgagcactgcctccgggcctcccctgagaccacactcagcagtggcttcttcgttgctgtaattgaacgggtcgaggtgccaagcctcacaggccaaagcatcagcaccagaacgcacacccagcccagccccaaagagaaagaagagacagcaaagagccgcagccggtgcttgcacaccgccttgcacatagcagaggctccgggctga

SEQ ID NO: 13238 - DNA, 91 bp, Artificial Sequence
  Synthetic polypeptide
tccactcctttctcttcagcccctcggacactgcctagcctcgatgacttacgagccctcaaggggaagcattttctcctggaccccttga

SEQ ID NO: 13239 - DNA, 497 bp, Artificial Sequence
  Synthetic polypeptide
gttgcgccgccccggccaagcctcagcctttctgggccttagcttcttcacgtgtaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13240 - DNA, 398 bp, Artificial Sequence
  Synthetic polypeptide
gttgcgccgccccggccaagcctcagcctttctgggccttagcttcttcacgtgtaggtgaagtcggtgccacttctgccctggcccccaagatcggccccctgggtctgattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13241 - DNA, 285 bp, Artificial Sequence; identical to SEQ ID NO: 6932
  Synthetic polypeptide

SEQ ID NO: 13242 - DNA, 333 bp, Artificial Sequence; identical to SEQ ID NO: 6933
  Synthetic polypeptide

SEQ ID NO: 13243 - DNA, 207 bp, Artificial Sequence; identical to SEQ ID NO: 6934
  Synthetic polypeptide

SEQ ID NO: 13244 - DNA, 555 bp, Artificial Sequence; identical to SEQ ID NO: 6935
  Synthetic polypeptide

SEQ ID NO: 13245 - DNA, 225 bp, Artificial Sequence; identical to SEQ ID NO: 6936
  Synthetic polypeptide

SEQ ID NO: 13246 - DNA, 665 bp, Artificial Sequence; identical to SEQ ID NO: 6745
  Synthetic polypeptide

SEQ ID NO: 13247 - DNA, 369 bp, Artificial Sequence
  Synthetic polypeptide
ggctgggcccagtagctcgtgcctgtaatcccagcattttggtaggctgaggcgggtggatggctcgagctcaggagttcgagagcagcctgggtaacatggcgaaacccctcccccccccccccccccgtctccaaaaaatacaatagccagcgtggtgcagccgtctgtagtcccagctactctggaggctcagaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 13248 - DNA, 509 bp, Artificial Sequence; identical to SEQ ID NO: 7445
  Synthetic polypeptide

SEQ ID NO: 13249 - DNA, 1198 bp, Artificial Sequence
  Synthetic polypeptide
cagtggttcttaactaggggtgattctatttcttcttctcctgagggaacatgtggcaatctcaagagacatttttggttgccaggggaagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctga

SEQ ID NO: 13250 - DNA, 587 bp, Artificial Sequence; identical to SEQ ID NO: 10160
  Synthetic polypeptide

SEQ ID NO: 13251 - DNA, 1246 bp, Artificial Sequence; identical to SEQ ID NO: 10161
  Synthetic polypeptide

SEQ ID NO: 13252 - DNA, 1768 bp, Artificial Sequence; identical to SEQ ID NO: 10162
  Synthetic polypeptide

SEQ ID NO: 13253 - DNA, 1054 bp, Artificial Sequence; identical to SEQ ID NO: 10163
  Synthetic polypeptide

SEQ ID NO: 13254 - DNA, 553 bp, Artificial Sequence; identical to SEQ ID NO: 10164
  Synthetic polypeptide

SEQ ID NO: 13255 - DNA, 118 bp, Artificial Sequence
  Synthetic polypeptide
caggggatccgagccaggagacactgagcctttggagttaggaggtcctggagcagaacctgaacagaaagaacaatcgacaggacagaagcggcctttgaagaacgacgaactataa

SEQ ID NO: 13256 - DNA, 2395 bp, Artificial Sequence
  Synthetic polypeptide
atcctggagtacctgtctggtacctggtacccggcacactgtgagttcctggacatcaagggctggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactga

SEQ ID NO: 13257 - DNA, 333 bp, Artificial Sequence
  Synthetic polypeptide
gagacagtttgcggctgtggaaacacacgtgctcgcaaatcaaagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctga

SEQ ID NO: 13258 - DNA, 393 bp, Artificial Sequence
  Synthetic polypeptide
accagttacctcatctttaacatgaagaaaataagagctacccccagggctgttttaaggagtaaatgaataatggacatgaacatttaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataa

SEQ ID NO: 13259 - DNA, 1003 bp, Artificial Sequence
  Synthetic polypeptide
caggaagtccccttcattgctgtgtggacgtggtagataaagtgttctcaagctggaaagatttaacagattggcccctcggggacctggacattgaatattttactgatggaagcagtttcgtactaaggggagtctgccgagctgggtatgccgcggtgactttggactcagcagtagaggtaccgtctctgtctgcagaaacttctgcttagaaagcagagctaatagctctgacaagagctctctggctaggaaaagagcagaaggcaagtatttacacagattccaaatatgcttctgccactttgcatgttcatgaggctgtttacaaagaataaaagacttttaacggctggaagtgaaaaaacaaagtataaggaggaaattccacctctgttaaacgctgtgtgggccctggaagaggtggcagtgatgcgctgcaggaggccccgaaaagcagcaaagcagaaaggcagacgaagaggcaaacgggctgcaacgacaactccaccttctagagaggaagccttagctatgcctcccgctcccggagattcccctcctggggatcccaaggtcccctccaaacgaaaagtcttggtttgcccacaagaataagaactacattgaagaaagatgtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 13260 - DNA, 812 bp, Artificial Sequence; identical to SEQ ID NO: 693
  Synthetic polypeptide

SEQ ID NO: 13261 - DNA, 752 bp, Artificial Sequence; identical to SEQ ID NO: 694
  Synthetic polypeptide

SEQ ID NO: 13262 - DNA, 149 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaa

SEQ ID NO: 13263 - DNA, 627 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaa

SEQ ID NO: 13264 - DNA, 822 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttga

SEQ ID NO: 13265 - DNA, 300 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtctgagatag

SEQ ID NO: 13266 - DNA, 750 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgaccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccagggaaacaccatccaggacgcacctcaccccctcaccctgctccatcccagcaggaccctcattcacaccaagtccccttggggccagaagttgcttgagttcataaaacatgtctgttatcacagacatcagagccacaggccgtgcgctccagggtggttttgccaagtgctgcagaggccaggtgctgtctcaggagagaagacccagcagacccggccagcccctccagccacctgtctgctctgcctctcgtgcctctcaggcttccggcatgggccgtggaggtcacaggctctgcccagtgacctcgtggccccactgtttgtcagttacactgtggaggtgagcatcacaaacgcagggtggagttttcccgcagctgtgtga

SEQ ID NO: 13267 - DNA, 249 bp, Artificial Sequence; identical to SEQ ID NO: 12109
  Synthetic polypeptide

SEQ ID NO: 13268 - DNA, 198 bp, Artificial Sequence; identical to SEQ ID NO: 12110
  Synthetic polypeptide

SEQ ID NO: 13269 - DNA, 394 bp, Artificial Sequence; identical to SEQ ID NO: 8700
  Synthetic polypeptide

SEQ ID NO: 13270 - DNA, 147 bp, Artificial Sequence; identical to SEQ ID NO: 8977
  Synthetic polypeptide

SEQ ID NO: 13271 - DNA, 144 bp, Artificial Sequence; identical to SEQ ID NO: 8978
  Synthetic polypeptide

SEQ ID NO: 13272 - DNA, 1226 bp, Artificial Sequence; identical to SEQ ID NO: 12573
  Synthetic polypeptide

SEQ ID NO: 13273 - DNA, 170 bp, Artificial Sequence; identical to SEQ ID NO: 12574
  Synthetic polypeptide

SEQ ID NO: 13274 - DNA, 446 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggacttccggaataaagtggatgactacatcaaacgttatgccagatga

SEQ ID NO: 13275 - DNA, 281 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggct

SEQ ID NO: 13276 - DNA, 401 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggac

SEQ ID NO: 13277 - DNA, 383 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgaggacttccggaataaagtggatgactacatcaaacgttatgccagatga

SEQ ID NO: 13278 - DNA, 194 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgtttattgagagaacattcaattga

SEQ ID NO: 13279 - DNA, 260 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatgtcgtttggggattaa

SEQ ID NO: 13280 - DNA, 284 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtggatcttttgaattttgatgatccactgaatattgaagctgcagaacatcatttgcgggacaaggaggacttccggaataaagtggatgactacatcaaacgttatgccagatga

SEQ ID NO: 13281 - DNA, 251 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgaggatcttttga

SEQ ID NO: 13282 - DNA, 403 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaacatcatttgcgggacaaggaggactt

SEQ ID NO: 13283 - DNA, 377 bp, Artificial Sequence
  Synthetic polypeptide
ggccaggtgtggtggctcatgcctgtaatcccagcactttggggaggccaagatgggcagatcgcttgtggtcaggagtttgagaccagcgtgggcagcatgatgagggttactaccagggtggaaaatttcagtttgaaactgaagttcccgatgcgtacaacatggtgcctcccaaagtgaaatgcctgaccaagatctggcaccccaacatcacagagacaggggaaatatgtctgagtttattgagagaacattcaattgatggcactggctgggctcccacaagaacattaaaggatgtcgtttggggattaaactctttgtttactgatcttttgaattttgatgatccactgaatattgaagctgcagaa

SEQ ID NO: 13284 - DNA, 315 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatc

SEQ ID NO: 13285 - DNA, 1020 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctga

SEQ ID NO: 13286 - DNA, 702 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagact

SEQ ID NO: 13287 - DNA, 493 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgc

SEQ ID NO: 13288 - DNA, 71 bp, Artificial Sequence
  Synthetic polypeptide
agctctgtgaccttatgctccacactaactctggcagagcctccgtttcctcatagcacaaagatgcagat

SEQ ID NO: 13289 - DNA, 57 bp, Artificial Sequence
  Synthetic polypeptide
agctctgtgaccttatgctccacactaactctggcagagcctccgtttcctcatagc

SEQ ID NO: 13290 - DNA, 232 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacacct

SEQ ID NO: 13291 - DNA, 270 bp, Artificial Sequence
  Synthetic polypeptide
agctctgtgaccttatgctccacactaactctggcagagcctccgtttcctcatagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacact

SEQ ID NO: 13292 - DNA, 892 bp, Artificial Sequence; identical to SEQ ID NO: 12685
  Synthetic polypeptide

SEQ ID NO: 13293 - DNA, 1075 bp, Artificial Sequence; identical to SEQ ID NO: 12686
  Synthetic polypeptide

SEQ ID NO: 13294 - DNA, 197 bp, Artificial Sequence; identical to SEQ ID NO: 12687
  Synthetic polypeptide

SEQ ID NO: 13295 - DNA, 769 bp, Artificial Sequence; identical to SEQ ID NO: 12688
  Synthetic polypeptide

SEQ ID NO: 13296 - DNA, 952 bp, Artificial Sequence; identical to SEQ ID NO: 12689
  Synthetic polypeptide

SEQ ID NO: 13297 - DNA, 1052 bp, Artificial Sequence
  Synthetic polypeptide
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtga

SEQ ID NO: 13298 - DNA, 483 bp, Artificial Sequence
  Synthetic polypeptide
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgg

SEQ ID NO: 13299 - DNA, 402 bp, Artificial Sequence
  Synthetic polypeptide
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcag

SEQ ID NO: 13300 - DNA, 230 bp, Artificial Sequence
  Synthetic polypeptide
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgca

SEQ ID NO: 13301 - DNA, 866 bp, Artificial Sequence
  Synthetic polypeptide
tttggcgtgcaacatggggcttgagaaaggagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtag

SEQ ID NO: 13302 - DNA, 1024 bp, Artificial Sequence; identical to SEQ ID NO: 794
  Synthetic polypeptide

SEQ ID NO: 13303 - DNA, 1323 bp, Artificial Sequence
  Synthetic polypeptide
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaa

SEQ ID NO: 13304 - DNA, 1470 bp, Artificial Sequence
  Synthetic polypeptide
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaaggtcgtgatatcattgggcttgcagaaactggctctggaaagacaggcgcctttgctttgcccattctaaacgcactgctggagaccccgcagcgtttgtttgccctagttcttaccccgactcgggagctggcctttcagatctcagagcagtttgaagccctggggtcctctattggagtgcagagtgctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaaggatacctacctggtttatattctaaatgaattggctggaaactcctttatgatattctgcagcacctgtaataatacccagagaacagctttgctactgcgaaatcttggcttcactgccatccccctccatggacaaatgagtcagagtaagcgcctaggatcccttaataagtttaaggccaaggcccgttccattcttctagcaactgacgttgccagccgaggtttggacatacctcatgtagatgtggttgtcaactttgacattcctacccattccaaggattacatccatcgagtaggtcgaacagctagagctgggcgctccggaaaggctattacttttgtcacacagtatgatgtggaactcttccagcgcatagaacacttaattgggaagaaactaccaggttttccaacacaggatgatgaggttatgatgctgacagaacgcgtcgctgaagcccaaaggtttgcccgaatggagttaagggagcatggagaaaagaagaaacgctcgcgagaggatgctggagataatgatgacacagagggtgctattggtgtcaggaacaaggtggctggaggaaaaatgaagaagcggaaaggccgttaa

SEQ ID NO: 13305 - DNA, 691 bp, Artificial Sequence
  Synthetic polypeptide
gagctttggagtcagatgaaccaaccagatttgaattttgacacagtctcttactgaggacaagttgttacctctctgtgtttctctttccacatctgtaaattggggatagtaataagtacttacctcgcagaattgttgtgacgattaaatgagatgatacatgtaaagcacctggccttggccttgggtgtgacagatgtgttgtgtgaagcttgtgaccagttgggatggacaaaacccaccaagatccagattgaagctattcctttggccttacaagctgtgattgtaggtggaattgattcaatgtctcaatctttggcccttgcaaaaaaaccacatataataatagcaactcctggtcgactgattgaccacttggaaaatacgaaaggtttcaacttgagagctctcaaatacttggtcatggatgaagccgaccgaatactgaatatggattttgagacagaggttgacaagatcctcaaagtgattcctcgagatcggaaaacattcctcttctctgccaccatgaccaagaaggttcaaaaacttcagcgagcagctctgaagaatcctgtgaaatgtgccgtttcctctaaataccagacagttgaaaaattacagcaatattatatttttattccctctaaattcaagagtaagcgcctaggatcccttaataagt

SEQ ID NO: 13306 - DNA, 1752 bp, Artificial Sequence
  Synthetic polypeptide
ggccagtcacggtggctcacgcctgtaatcccagcactttgggaggctgaggcgggtggatcacttgagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13307 - DNA, 1872 bp, Artificial Sequence
  Synthetic polypeptide
ggccagtcacggtggctcacgcctgtaatcccagcactttgggaggctgaggcgggtggatcacttgagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaagccctcgagcatgttccaaactcggttcgcttgtggaaagcagccgttgagctggaagaacctgaagatgctagaatcatgctgagccgagctgtggagtgctgccccaccagcgtggagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggatgccgaggaatgtgacagggctgggagtgtggccacctgccaggccgtcatgcgtgccgtgattgggattgggattgaggaggaagatcggaagcatacctggatggaggatgctgacagttgtgtagcccacaatgccctggagtgtgcacgagccatctacgcctacgccctgcaggtgttccccagcaagaagagtgtgtggctgcgcgccgcgtacttcgagaagaaccatggcactcgggagtccctggaagcactcctgcagagggctgtggcccactgccccaaagcagaggtgctgtggctcatgggcgccaagtccaagtggctggcaggggatgtgcctgcagcaaggagcatcctggccctggccttccaggccaaccccaacagtgaggagatctggctggcagccgtgaagctggagtccgagaatgatgagtacgagcgggcccggaggctgctggccaaggcgcggagcagtgcccccaccgcccgggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccaggggttgaagaagtgtccccactccacacccctgtggcttttgctctctcggctggaggagaagattgggcagcttactcgagcacgggccattttggaaaagtctcgtctgaagaacccaaagaaccctgggctgtggttggagtccgtgcggctggagtaccgtgcggggctgaagaacatcgcaaatacactcatggccaaggcgctgcaggagtgccccaactccggtatcctgtggtctgaggccatcttcctcgaggcaaggccccagaggaggaccaagagcgtggatgccctgaagaagtgtgagcatgacccccatgtgctcctggccgtggccaagctgttttggagtcagcggaagatcaccaaggccagggagtggttccaccgcactgtgaagattgactcggacctgggggatgcctgggccttcttctacaagtttgagctgcagcatggcactgaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctga

SEQ ID NO: 13308 - DNA, 311 bp, Artificial Sequence
  Synthetic polypeptide
ggccgggtgtggtggttcatgcctctcatcccagcacttcaggaggctgaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 13309 - DNA, 370 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13310 - DNA, 361 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13311 - DNA, 2405 bp, Artificial Sequence; identical to SEQ ID NO: 8354
  Synthetic polypeptide

SEQ ID NO: 13312 - DNA, 2252 bp, Artificial Sequence; identical to SEQ ID NO: 8355
  Synthetic polypeptide

SEQ ID NO: 13313 - DNA, 2240 bp, Artificial Sequence; identical to SEQ ID NO: 8356
  Synthetic polypeptide

SEQ ID NO: 13314 - DNA, 183 bp, Artificial Sequence
  Synthetic polypeptide
ggccgggcacggtggctcacgcttgtaatcccagcactttgggagtccaagggccccaactttgagttctccacggagacccatgaggagctgctgtacaacaaggagaagttgctcaacaacggggacaagtgggaggccgagatcgccgccaacatccaggctgactacttgtatcggtga

SEQ ID NO: 13315 - DNA, 104 bp, Artificial Sequence
  Synthetic polypeptide
ggccgggcacggtggctcacgcttgtaatcccagcactttgggagtccaagggccccaactttgagttctccacggagacccatgaggagctgctgtacaacaa

SEQ ID NO: 13316 - DNA, 491 bp, Artificial Sequence
  Synthetic polypeptide
gcagtggctcaagcctgtaattccagcgctttgggaggccgaggtgggaagacagcttgaggccaggagttggggaccagcctgggcaatatagcgagaccctatctctacaaaaaataaataacaaaaaatactagccaggcgtggtggcacacacctgtagtcctggctgcttggaaggctgaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctga

SEQ ID NO: 13317 - DNA, 213 bp, Artificial Sequence
  Synthetic polypeptide
gcagtggctcaagcctgtaattccagcgctttgggaggccgaggtgggaagacagcttgaggccaggagttggggaccagcctgggcaatatagcgagaccctatctctacaaaaaataaataacaaaaaatactagccaggcgtggtggcacacacctgtagtcctggctgcttggaaggctgaggggtgctggcactgtgggtcctggtga

SEQ ID NO: 13318 - DNA, 198 bp, Artificial Sequence
  Synthetic polypeptide
ggctgggcatggtggcgcacgcctgtaatcccggcacgttgggaggccgaggcctctcttcagcttctggagacctcactatcctattatgtctttgtgtgaagacatgctgctttgtaattatcgaaagtgtcgcatcaaactctctggctatgcatgggtcactgcctgctctcacatcttctgtgatcagcatgg

SEQ ID NO: 13319 - DNA, 1016 bp, Artificial Sequence; identical to SEQ ID NO: 6795
  Synthetic polypeptide

SEQ ID NO: 13320 - DNA, 1187 bp, Artificial Sequence; identical to SEQ ID NO: 6796
  Synthetic polypeptide

SEQ ID NO: 13321 - DNA, 965 bp, Artificial Sequence; identical to SEQ ID NO: 6797
  Synthetic polypeptide

SEQ ID NO: 13322 - DNA, 306 bp, Artificial Sequence
  Synthetic polypeptide
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtag

SEQ ID NO: 13323 - DNA, 336 bp, Artificial Sequence
  Synthetic polypeptide
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtgagggcggggcctggaggggcagacggggtggccataaaagacaagcaggaaggaattgagtag

SEQ ID NO: 13324 - DNA, 625 bp, Artificial Sequence; identical to SEQ ID NO: 6804
  Synthetic polypeptide

SEQ ID NO: 13325 - DNA, 598 bp, Artificial Sequence; identical to SEQ ID NO: 6805
  Synthetic polypeptide

SEQ ID NO: 13326 - DNA, 586 bp, Artificial Sequence; identical to SEQ ID NO: 6809
  Synthetic polypeptide

SEQ ID NO: 13327 - DNA, 1243 bp, Artificial Sequence
  Synthetic polypeptide
ccccactgggtctgtctctgcatctgtgaaatggctgagtgtgaccaaatgatgcagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctag

SEQ ID NO: 13328 - DNA, 1618 bp, Artificial Sequence
  Synthetic polypeptide
ccccactgggtctgtctctgcatctgtgaaatggctgagtgtgaccaaatgatgcagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctga

SEQ ID NO: 13329 - DNA, 1002 bp, Artificial Sequence
  Synthetic polypeptide
tcggcttcctgtgtaaagtgagactgatttcccgctctgctcagcccaggccacaggtttttgcgaggatccgttgagatgaacctgaaggctctccggaaattgcgctaggttacaggagtgtaagatatccttggaacagaagatcttattgtggaagtgacttccaatgatgctgtgagattttatccctggaccattgataataaatactattcagcagacatcaatctatgtgtggtgccaaacaaatttcttgttactgcagagattgcagaatctgtccaagcatttgtggtttactttgacagcacacaaaaatcgggccttgatagtgtctcctcatggcttccactggcaaaagcatggttacctgaggtgatgatcttggtctgcgatagagtgtctgaagatggtataaaccgacaaaaagctcaagaatggtgcatcaaacatggctttgaattggtagaacttagtccagaggagttgcctgaggaggatgatgacttcccagaatctacaggagtaaagcgaattgtccaagccctgaatgccaatgtgtggtccaatgtagtgatgaagaatgataggaaccaaggctttagccttctcaactcattgactggaacaaaccatagcattgggtcagcagatccctgtcacccagagcaaccccatttgccagcagcagatagtactgaatccctctctgatcatcggggtggtgcatctaacacaacagatgcccaggttgatagcattgtggatcccatgttagatctggatattcaagaattagccagtcttaccactggaggaggagatgtggagaattttgaaagactcttttcaaagttaaaggaaatgaaagacaaggctgcgacgcttcctcatgagcaaagaaaagtgcatgcagaaaaggtggccaaagcattctggatggcaatcgggggagacagagatgaaattgaaggcctttcatctgatgaagagcactga

SEQ ID NO: 13330 - DNA, 654 bp, Artificial Sequence; identical to SEQ ID NO: 6998
  Synthetic polypeptide

SEQ ID NO: 13331 - DNA, 651 bp, Artificial Sequence; identical to SEQ ID NO: 6999
  Synthetic polypeptide

SEQ ID NO: 13332 - DNA, 498 bp, Artificial Sequence; identical to SEQ ID NO: 7000
  Synthetic polypeptide

SEQ ID NO: 13333 - DNA, 189 bp, Artificial Sequence; identical to SEQ ID NO: 7001
  Synthetic polypeptide

SEQ ID NO: 13334 - DNA, 1421 bp, Artificial Sequence
  Synthetic polypeptide
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13335 - DNA, 1277 bp, Artificial Sequence
  Synthetic polypeptide
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13336 - DNA, 226 bp, Artificial Sequence
  Synthetic polypeptide
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacat

SEQ ID NO: 13337 - DNA, 248 bp, Artificial Sequence
  Synthetic polypeptide
ggccaggcgcggtggctcatgcctgtaatcccagcactttgggaggtgaaggtggacggatcacgaggtcaggagatcgagaccatcctggctaacacgatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 13338 - DNA, 381 bp, Artificial Sequence
  Synthetic polypeptide
ggcagagcgccgtggcttaggcctgtaatcccagcacggggaggtggaggcgggtggatcactgtagagaccagcctgggcaacatgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaattcccagagtttcaattgtaa

SEQ ID NO: 13339 - DNA, 360 bp, Artificial Sequence
  Synthetic polypeptide
ggcagagcgccgtggcttaggcctgtaatcccagcacggggaggtggaggcgggtggatcactgtagagaccagcctgggcaacatgaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggtaataggtcaacattttatcatggaaaggttcagccacagtgagagtggattttag

SEQ ID NO: 13340 - DNA, 2300 bp, Artificial Sequence
  Synthetic polypeptide
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagaggtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtga

SEQ ID NO: 13341 - DNA, 2444 bp, Artificial Sequence
  Synthetic polypeptide
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtga

SEQ ID NO: 13342 - DNA, 599 bp, Artificial Sequence
  Synthetic polypeptide
actaagcaattaacaggactagactcagaggtgatcgagaaattgaaacaggctggaaatttaaattaactgtgattaatatgtggaggtctcttgtacgaaaggtgaacaatatgcatgaggaggaaactcatcaaattataagaaaggaagaacgctgataacaggtaatttttctgatggggcagcagtaggatcaacacagctgagaaaaataggaattacccacgttggaaaataaagaagaaaaaaagtttttttttaaaaaaagcatccaagaactgtgggaaaatatcaaatgatatcatatgcatgtaataggactcccaaaagaagaagaaagaacaaatcataaaaaatgtttgaagagaaaattaccaataattttcccaaaataatgaaagacctgagctcagagcacacacaaaacttgataaatatgagcccctgcctgacacatgcagtgtattcaaactgtggaaatcagagagaaaaccatgaagatggccggaggaaaaagatacgttaaatacagtaacaaagaacctgcaaccatggtcgtgccactagccagctcggaagcccagctgcacagatga

SEQ ID NO: 13343 - DNA, 644 bp, Artificial Sequence; identical to SEQ ID NO: 7217
  Synthetic polypeptide

SEQ ID NO: 13344 - DNA, 518 bp, Artificial Sequence
  Synthetic polypeptide
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggccatgggtgtgtacctctacggggagctgatggtgagtgaggacgccagacagcagcagctcgcccgtaggtgcttcgagcggaccaaggagcagatggataggtcctcagcccaggtggtggccgaaatgttattttaa

SEQ ID NO: 13345 - DNA, 413 bp, Artificial Sequence
  Synthetic polypeptide
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagcttcttccagaccagctggtcttgcttctggagcatctcttggagcagaagactctgagcccccgaactctgcaaagcctccagaggacataccacctccaggatcaggatgcagaggttcgccatcggtggtgtgaactcattgttaagcacaagttcacgaaagcctacaaaagtgtggagaggttccttcaggaggatcaggtaggtgtcatctttcagcagatggggattctgtaa

SEQ ID NO: 13346 - DNA, 296 bp, Artificial Sequence
  Synthetic polypeptide
gggcgcggagccgggggaggggtggcgggggcaagccgctgcagagggagcgtcgcgccggggcggagtgcgggcttgcgcggcaagtgcgcgccgaggtcacgaaatggattggagtgaaccggagaccccgaaaacggaagcgcagggagaaggaagaggtgtttgaaaagactttaaattggagtcatctaagaaatagagagagaagaagaaagaagtggattacttttaaaacactaggaggaattttatttactgtaaagcagatgagaaatttgtttgcccaagtttag

SEQ ID NO: 13347 - DNA, 585 bp, Artificial Sequence
  Synthetic polypeptide
tgggcaaaggacttgtggagttcaaagacgtacaagtgatcaacaaacacatggaaagttctcaacatcattagtcattaaagaaatgcacataaaaaaccacaatgaggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctga

SEQ ID NO: 13348 - DNA, 1011 bp, Artificial Sequence
  Synthetic polypeptide
tatggatttcctactaatcagcaatagagaaaacttctactccaggctgttgccaggactgtagtctcagacagttgtagcccaattcctacccaactttttattggaagaaataataacatttatgggaaataactcaaaggatatggagttcattagtttttccagaaattctaacttttatccctggatcaggccagataatcagatttttatgtttttttttccttgccagatcactttagtgtgttgtactttggtgtcgtatttcatgttgtgggatgcagtaagaagacattataggagactccctactgtgtatacttagagacattgttaattaattactctcctcttcctccccaaatgtggatgataaaggatcctttgaggctgattactctgagtgcaaaccttttcactgttccagagaggagcctgacaaccacattctccttctcaagatataagagttcggaccgcccagcacacaaggtcagcatgctgctcctctgtcacgctctcgctatagctgttgtccagatcgttatcttctcagaaagctgggcatttgccaagaacatcaacttctataatgtgaggcctcctctcgaccctacaccatttccaaatagcttcaagtgctttacttgtgaaaacgcaggggataattataactgcaatcgatgggcagaagacaaatggtgtccacaaaatacacagtactgtttgacagttcatcacttcaccagccacggaagaagcacatccatcaccaaaaagtgtgcctccagaagtgaatgtcattttgtcggttgccaccacagccgagattctgaacatacggagtgtaggtcttgctgtgaaggaatgatctgcaatgtagaattacccaccaatcacactaatgcagtgtttgccgtaatgcacgctcagagaacatctggcagcagtgcccccacactctacctaccagtgcttgcctgggtctttgtgcttccattgctgtga

SEQ ID NO: 13349 - DNA, 612 bp, Artificial Sequence
  Synthetic polypeptide
tatggatttcctactaatcagcaatagagaaaacttctactccaggctgttgccaggactgtagtctcagacagttgtagcccaattcctacccaactttttattggaagaaataataacatttatgggaaataactcaaaggatatggagttcattagtttttccagaaattctaacttttatccctggatcaggccagataatcagatttttatgtttttttttccttgccagatcactttagtgtgttgtactttggtgtcgtatttcatgttgtgggatgcagtaagaagacattataggagactccctactgtgtatacttagagacattgttaattaattactctcctcttcctccccaaatgtggatgataaaggatcctttgaggctgattactctgagtgcaaaccttttcactgttccagagaggagcctgacaaccacattctccttctcaagatgtgaaaggcattgtacagaagaagatgagaatcacagtaaaccaaacaaaggaaatgcagaagagatattttcagctgaatattggaaagtaagattccctgcgagcaggatctcaggcaacgtcaatgaacaacatgaagcctga

SEQ ID NO: 13350 - DNA, 618 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13351 - DNA, 501 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13352 - DNA, 405 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaaggtaccctga

SEQ ID NO: 13353 - DNA, 297 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcggaacggggccaggcctga

SEQ ID NO: 13354 - DNA, 567 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctgcccgagcccagtcccctgaggcccaagcgggagaaacggccccgcctgccccggaaactcaagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtga

SEQ ID NO: 13355 - DNA, 450 bp, Artificial Sequence
  Synthetic polypeptide
cttactttctgagcctcggtgacctcatgtgacaagtggaggtgctgcccttcccatccttccttggatctgatgacaaggagaggtgactcagatgccactgcatcatcagataacagcgagacggaggggacacccaagttgtctgacacaccggcccctaagaggaagagaagccctccgctggggggcgccccctctccctccagcctctccctgcctccttcaacagggtttccccttcaggcctccggggtcccctccccatacctgagctcgctggcctcctcccgctaccccccattcccttctgactacctggccctgcagctgcccgagcccagtcccctgaggcccaagcgggagaaacggccccgcctgccccggaaactcaagacactggtggtcagagaacagactgagcggtggagtgagttgggacgggagtga

SEQ ID NO: 13356 - DNA, 493 bp, Artificial Sequence
  Synthetic polypeptide
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacaca

SEQ ID NO: 13357 - DNA, 1186 bp, Artificial Sequence
  Synthetic polypeptide
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctga

SEQ ID NO: 13358 - DNA, 1021 bp, Artificial Sequence
  Synthetic polypeptide
ggcagcatggttcaggccagcagaaggagcctggagggttggtggagagacccagcctcttgtgtcagctctgatgccaaccagctgtggattattgggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccacggcgagctggaggccacggaggagagcgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctga

SEQ ID NO: 13359 - DNA, 926 bp, Artificial Sequence; identical to SEQ ID NO: 8671
  Synthetic polypeptide

SEQ ID NO: 13360 - DNA, 890 bp, Artificial Sequence; identical to SEQ ID NO: 8672
  Synthetic polypeptide

SEQ ID NO: 13361 - DNA, 878 bp, Artificial Sequence; identical to SEQ ID NO: 8673
  Synthetic polypeptide

SEQ ID NO: 13362 - DNA, 2231 bp, Artificial Sequence; identical to SEQ ID NO: 9963
  Synthetic polypeptide

SEQ ID NO: 13363 - DNA, 650 bp, Artificial Sequence; identical to SEQ ID NO: 9089
  Synthetic polypeptide

SEQ ID NO: 13364 - DNA, 1052 bp, Artificial Sequence; identical to SEQ ID NO: 9090
  Synthetic polypeptide

SEQ ID NO: 13365 - DNA, 419 bp, Artificial Sequence
  Synthetic polypeptide
acagctgtttgtttttctgaccaacattgttcctccacctcccacccaagagaagcactgttttctttatggtgggaattactcctcctcaaccttttgggtcctggtggggctgcaaatcatagtaccctgtctcttctgggaagagcaccttctgatagggtgatcacagtgtcccgtggcctgtcacatacttgtgtatgtggcccaagctgggccagtcaccatttcctgggagttaatttaggaaccctgagagacagacaacagtgagctgggacggagacaagctccagtgtgtgcagaagggtgagaaggaggggcgtggctggacccagtggatcgagggtgatgagctgcacctggagatgagagtggaaggtgtggtctgcaagcaagtattcaagaaggtgcagtga

SEQ ID NO: 13366 - DNA, 1325 bp, Artificial Sequence
  Synthetic polypeptide
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccaaaaacaagcctggagttttatattgacatccatgcccactccaccatgatgaatggcttcatgtatggcaacatctttgaggatgaggaacggttccagaggcaggccatttttcccaagctcctctgccagaatgctgaggacttctcctattccagcacatcctttaaccgggacgctgtgaaagcaggaactggccgtcgcttcctcggtggactcctggaccacacttcctattgctacaccctagaggtctccttctacagctacatcatcagtggcaccacggctgctgtgccctacactgaagaagcctatatgaagctggggcggaatgtggcaagaacctttttggactattatcggctgaaccccgtggttgaaaaggtggcaattcccatgccgagactgcgaaataaagaaatagaagtccagagaaggaaagaaaaatcccctccttacaagcacccactcctgcggggcccagccagcaactaccccaacagcaaaggggacaagaagagctcagtgaaccacaaagacccttcaacccctttttaa

SEQ ID NO: 13367 - DNA, 776 bp, Artificial Sequence
  Synthetic polypeptide
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgacaatctccgggaaggggcagagcagaaggtggtattcatcacaggacgagtccacccaggggaaacaccctcatcatttgtgtgccaagggatcattgacttccttgtaagccagcaccctattgcctgtgtcctccgggaatacctggtcttcaagatcgcaccaatgctcaatcctgatggagtctacctgggcaattacaggtgttctctgatgggatttgatctgaatcgtcactggctggatccctctccatgggtccatcctaccctgcatggagtgaaacaactcatcgtccagatgtacaacgacccagtaagtaactga

SEQ ID NO: 13368 - DNA, 467 bp, Artificial Sequence
  Synthetic polypeptide
ggaggagccaagatggccgaataggaacagctctggtctacagctcccagcgtgagtgacgcagaagatgggtgatttctgcatttccatctgagagggtcattttcaacattgttaacttcagtaaaaccaagagtctctatagagatgggatggcccctatggtgaaatctaccagcagaccaaaatggcaaaggctgccacccaaaaatgtttactactaccgctgcccggaccataggaagaactatgtgatgtcctttgccttttgttttgaccgagaagaagatatttaccagtttgcttactgctacccatatacatacactcgcttccaacattaccttgacagcctgcaaaagagaaacatggattacttctttcgggagcagctgggccagagtgtgcaacaacgaaagcttgacctcctgacgataaccagccctgctggaagatggagctggtga

SEQ ID NO: 13369 - DNA, 1470 bp, Artificial Sequence
  Synthetic polypeptide
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtgttcggcctggactccatcatgggcaacaaggacctgtggcccctgctgctgagcatcatcttcatcccggccctgctgcagtgcatcgtgctgcccttctgccccgagagtccccgcttcctgctcatcaaccgcaacgaggagaaccgggccaagagtgtgctaaagaagctgcgcgggacagctgacgtgacccatgacctgcaggagatgaaggaagagagtcggcagatgatgcgggagaagaaggtcaccatcctggagctgttccgctcccccgcctaccgccagcccatcctcatcgctgtggtgctgcagctgtcccagcagctgtctggcatcaacgctgtcttctattactccacgagcatcttcgagaaggcgggggtgcagcagcctgtgtatgccaccattggctccggtatcgtcaacacggccttcactgtcgtgtcgctgtttgtggtggagcgagcaggccggcggaccctgcacctcataggcctcgctggcatggcgggttgtgccatactcatgaccatcgcgctagcactgctggagcagctaccctggatgtcctatctgagcatcgtggccatctttggctttgtggccttctttgaagtgggtcctggccccatcccatggttcatcgtggctgaactcttcagccagggtccacgtccagctgccattgccgttgcaggcttctccaactggacctcaaatttcattgtgggcatgtgcttccagtatgtggagcaactgtgtggtccctacgtcttcatcatcttcactgtgctcctggttctgttcttcatcttcacctacttcaaagttcctgagactaaaggccggaccttcgatgagatcgcttccggcttccggcaggggggagccagccaaagtgacaagacacccgaggagctgttccatcccctgggggctgattcccaagtgtga

SEQ ID NO: 13370 - DNA, 354 bp, Artificial Sequence
  Synthetic polypeptide
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcccaaacttga

SEQ ID NO: 13371 - DNA, 696 bp, Artificial Sequence
  Synthetic polypeptide
gagcactggaagctgacgggtcgcctcatgctggccgtgggaggagcagtgcttggctccctgcagtttggctacaacactggagtcatcaatgccccccagaaggtgatcgaggagttctacaaccagacatgggtccaccgctatggggagagcatcctgcccaccacgctcaccacgctctggtccctctcagtggccatcttttctgttgggggcatgattggctccttctctgtgggccttttcgttaaccgctttggccggcggaattcaatgctgatgatgaacctgctggccttcgtgtccgccgtgctcatgggcttctcgaaactgggcaagtcctttgagatgctgatcctgggccgcttcatcatcggtgtgtactgcggcctgaccacaggcttcgtgcccatgtatgtgggtgaagtgtcacccacagcccttcgtggggccctgggcaccctgcaccagctgggcatcgtcgtcggcatcctcatcgcccaggtaagctggggcaggatctacctgcctggcacggcccctgcccacagcttcagtggctctcggatctgtgcccagcagggcagagtttctcttccgcccagcccccacagccttgcagaggacaactatggtacacaggtccagagaacacagcaccatggcctcccagttgacagcaagatgacttga

SEQ ID NO: 13372 - DNA, 432 bp, Artificial Sequence
  Synthetic polypeptide
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccgggtgagggcggggcctggaggggcagacggggtgggctggacactggcccgtgtgcccaggcctgggacagccctggcctgtttcttcggaggtcctcagggagaggcggcggtgatggaagaacagggacttccaccacaggctccaggacatgtggactga

SEQ ID NO: 13373 - DNA, 303 bp, Artificial Sequence
  Synthetic polypeptide
gccaggatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtga

SEQ ID NO: 13374 - DNA, 306 bp, Artificial Sequence
  Synthetic polypeptide
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 13375 - DNA, 778 bp, Artificial Sequence
  Synthetic polypeptide
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaacaaagtggtccagcgacactcgcc

SEQ ID NO: 13376 - DNA, 499 bp, Artificial Sequence
  Synthetic polypeptide
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaacttctggcatggaaaagcccctgtgcaactggtaaagatatcaataagcaccaggaggtatctaaatccaccaggagccataggcatcacgttgacatccatttaccagtcttccctggcaagattcttctgaattgtgctgccttggccaaaagagctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacg

SEQ ID NO: 13377 - DNA, 186 bp, Artificial Sequence
  Synthetic polypeptide
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactatga

SEQ ID NO: 13378 - DNA, 186 bp, Artificial Sequence
  Synthetic polypeptide
gccaggatcaccattaacaaggacaccaaggtacccaatgcctgtttattcaccatcaacaaagaagaccacacactgggaaacatcattaaatcacgtgcctgcttccccttcgccttctgccgtgattgtcagtttcctgaggcctccccagccacgcttcctgtacagcctgcagaactgtga

SEQ ID NO: 13379 - DNA, 177 bp, Artificial Sequence
  Synthetic polypeptide
gccaggatcaccattaacaaggacaccaaggtacccaatgcctgtttattcaccatcaacaaagaagaccacacactgggaaacatcattaaatcgctggagtgcaatggcacgatcttgctcactgcaacctccgcctcccgggttcaagtgattctcctgcttcagccttcctag

SEQ ID NO: 13380 - DNA, 327 bp, Artificial Sequence
  Synthetic polypeptide
ggccgggcgcggtggctcactcctgtaatcccagcactttgggaggccaagttccggaactttaagatcatttaccgccgctatgctggcctctacttctgcatctgtgtggatgtcaatgacaacaacctggcttacctggaggccattcacaacttcgtggaggtcttaaacgaatatttccacaatgtctgtgaactggacctggtgttcaacttctacaaggtttacacggtcgtggacgagatgttcctggctggcgaaatccgagagaccagccagacgaaggtgctgaaacagctgctgatgctacagtccctggagtga

SEQ ID NO: 13381 - DNA, 805 bp, Artificial Sequence
  Synthetic polypeptide
ctgttaaggcatcatttctatgtgccatggctcactgctattactcgagccatttgtaaacaaatggtgttaaattcgtgctcagaacaatgcatgacaagggcctactcggcccccaggagttcaggaaacaggagccaggcagccataccctgtgaaaaactgtggtacggacttcgaggaagtaccctgagaggggggttatcagtgcacgtgggtgttcatttgcaccttttcaggaggttgaggccttccccacccggacagagaaggcactagaagtaaccaaggtgttgttaagagacattattcccagatttggactgcctctaactctaagatcagacaatagcccaatatttatggctgaaatagttcaggacttaacttgattattaaaaataaagtggaaattacatacagcttacaggctgcagagctcagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatag

SEQ ID NO: 13382 - DNA, 375 bp, Artificial Sequence; identical to SEQ ID NO: 860
  Synthetic polypeptide

SEQ ID NO: 13383 - DNA, 255 bp, Artificial Sequence; identical to SEQ ID NO: 862
  Synthetic polypeptide

SEQ ID NO: 13384 - DNA, 519 bp, Artificial Sequence; identical to SEQ ID NO: 9679
  Synthetic polypeptide

SEQ ID NO: 13385 - DNA, 213 bp, Artificial Sequence; identical to SEQ ID NO: 9680
  Synthetic polypeptide

SEQ ID NO: 13386 - DNA, 3621 bp, Artificial Sequence; identical to SEQ ID NO: 8171
  Synthetic polypeptide

SEQ ID NO: 13387 - DNA, 3312 bp, Artificial Sequence; identical to SEQ ID NO: 8172
  Synthetic polypeptide

SEQ ID NO: 13388 - DNA, 2928 bp, Artificial Sequence; identical to SEQ ID NO: 8173
  Synthetic polypeptide

SEQ ID NO: 13389 - DNA, 3435 bp, Artificial Sequence; identical to SEQ ID NO: 8174
  Synthetic polypeptide

SEQ ID NO: 13390 - DNA, 1331 bp, Artificial Sequence; identical to SEQ ID NO: 550
  Synthetic polypeptide

SEQ ID NO: 13391 - DNA, 1028 bp, Artificial Sequence; identical to SEQ ID NO: 551
  Synthetic polypeptide

SEQ ID NO: 13392 - DNA, 1295 bp, Artificial Sequence; identical to SEQ ID NO: 553
  Synthetic polypeptide

SEQ ID NO: 13393 - DNA, 1322 bp, Artificial Sequence; identical to SEQ ID NO: 554
  Synthetic polypeptide

SEQ ID NO: 13394 - DNA, 1013 bp, Artificial Sequence; identical to SEQ ID NO: 555
  Synthetic polypeptide

SEQ ID NO: 13395 - DNA, 1584 bp, Artificial Sequence; identical to SEQ ID NO: 8495
  Synthetic polypeptide

SEQ ID NO: 13396 - DNA, 1242 bp, Artificial Sequence; identical to SEQ ID NO: 8496
  Synthetic polypeptide

SEQ ID NO: 13397 - DNA, 1539 bp, Artificial Sequence; identical to SEQ ID NO: 8497
  Synthetic polypeptide

SEQ ID NO: 13398 - DNA, 1623 bp, Artificial Sequence; identical to SEQ ID NO: 8498
  Synthetic polypeptide

SEQ ID NO: 13399 - DNA, 1677 bp, Artificial Sequence; identical to SEQ ID NO: 8499
  Synthetic polypeptide

SEQ ID NO: 13400 - DNA, 1632 bp, Artificial Sequence; identical to SEQ ID NO: 8500
  Synthetic polypeptide

SEQ ID NO: 13401 - DNA, 555 bp, Artificial Sequence; identical to SEQ ID NO: 8501
  Synthetic polypeptide

SEQ ID NO: 13402 - DNA, 401 bp, Artificial Sequence; identical to SEQ ID NO: 8502
  Synthetic polypeptide

SEQ ID NO: 13403 - DNA, 166 bp, Artificial Sequence; identical to SEQ ID NO: 8503
  Synthetic polypeptide

SEQ ID NO: 13404 - DNA, 184 bp, Artificial Sequence
  Synthetic polypeptide
ggggaggagccaagatggccgaataggaacagctccggtctacagctcccagcgtgagcgacacagaagacgggtgatttctgcatttccatctgaggaatgggaagatacagtgcagtcggaagtgttactgagagaattttcacattatactatgatcacttgggattcctacataagctga

SEQ ID NO: 13405 - DNA, 2016 bp, Artificial Sequence
  Synthetic polypeptide
ggggaggagccaagatggccgaataggaacagctccggtctacagctcccagcgtgagcgacacagaagacgggtgatttctgcatttccatctgaggaatgggaagatacagtgcagtcggaagtgttactgagagaattttcacattatactatgatcacttgggattcctacataagctgactctgggtcgctttgaagctagtggaccacccacagcctttggaaattctagaaatctttttggacagcctccagatatgggctttgagactgcgcttgccccacagcacacctccttagatgaaattatcttttttgcatatgtacctgagaacgaaccccaggaaacgatctacagcaagaagttcggcaatatacactatggaaaagtgatacactctgggaaaactggaagagcttacataagaaaggtattgcaacatacgactcctaaaggatttttgtcctcagttattgcagaaatgaaagagccctttggattagaagaagtgaatgagagctcttgtttgtctagttcccttttgattaataaagctggaaatgtctataaactcactcttgattcacaagttgttcaggccttgtttgaagatacagatatagagaagactgtagtgcttcccgggtacagcagcttcctcatcacaagcattttagataataagaatgcattagccattgctaccatgcctgaaagtgcacccaacaatatgacctttctaaagagcacatggttcttatacaactttgggcaaaggaatggacgaacatggaaaatatattcaaaaccatgtaattattggtttcaacatgatgattcaccatccctcaacatcgtgaaatacattgatctgggaaactcttatgttttaaaagctaaggtcatacggaatgcaaaaggttttcgaatgcttgaaataccactactgactgtgtttgttggaaaccctaatttgttggaagttacagctgaagtgacttttgatgatactgacagttatgtaataacaatttctgcagctagcaaagttttacatcagggttcaacttcactggcatttattatgtggtcagcctctactgagtgctttgttacgacaatggtgccaacactgaaaagcagctgtagttatctcagatctatgcatcacattcctagcaaatttatcccatttgaagactggattagtggagttcataaagacagtcagggttttaacctcatcaaaactttgccgataaactacaggcctccatctaatatgggaattgctattccactcacagataatttttatcatgcagatcctagcaaacccataccaagaaacatgtttcacatgtcaaagaaaaccggtaaattcaaacagtgtgctaatgtttccactcgggaggagtgtaactgcacaaaggatcagaagttttcacatgctgttgctttctcggattgcagggaaaaagttcctcgctttaagtttccaattacacaatatccagtttctttggaaattatcaacgaggatggacgtgtcccattgcaatctccatatctggttactgtgactgaagtgaacatgaggcacaactggaaactgaaacacactgtgccagaaaatattaaaagaatgaaacaattagtagaaccaattcttggtgctgcagtgtataatccttcaggtctcaacttaagcataaagggctctgaacttttccactttagagtgaccgtcatttcaggagtaactttttgtaacttaattgaagaatttcagatttatgttgatgaggcaccattgccattcccaggacacacgcttattgccgtggcaacagcggtagtgctagggggattaatttttatagcatttatgtttcaactgcaaggcatccatccgtggaggacattccaaagatggattagaagaaaccaagagaagttttcaagtatctctctcagtgagctgattcatagatcaaagtctgaagagtga

SEQ ID NO: 13406 - DNA, 162 bp, Artificial Sequence
  Synthetic polypeptide
gggcatgatggttcacacctgtaatcccagcactttggaaagtcgaggcaggtggatcatttgaggtcaggagtttgagaccagcctggccaacatggatttaagaggggtgcagatcccggaatgcctgaaccaactgttttgagcctactttggggataa

SEQ ID NO: 13407 - DNA, 372 bp, Artificial Sequence
  Synthetic polypeptide
gggcatgatggttcacacctgtaatcccagcactttggaaagtcgaggcaggtggatcatttgaggtcaggagtttgagaccagcctggccaacatggatttaagaggggtgcagatcccggaatgcctgaaccaactgttttgagggtgtggtggctcacacctgtaatctcagcactttggaaagccaaggtgggaagatcatgggaggattgcttgaagctaggagttcaagaccagcctgggcaacgtagcgagacccatctctaccaaaaaaaaaaaacctactttggggataaaggattatttggtcttctggatttggaggcaatcagcggacagcatggaagatgtgtgctctggctcggataa

SEQ ID NO: 13408 - DNA, 516 bp, Artificial Sequence
  Synthetic polypeptide
gaggagccaagatggccgaataggaacagctccggtctacagctcccagcgtgagcgacgcagaagacgggtgatttctgcatttccatctgagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggtatga

SEQ ID NO: 13409 - DNA, 1083 bp, Artificial Sequence
  Synthetic polypeptide
gaggagccaagatggccgaataggaacagctccggtctacagctcccagcgtgagcgacgcagaagacgggtgatttctgcatttccatctgagttccgaagacagcacccaccaatgtaagcggaagaagtggaagaaggcatgagttagtcattgcctgggagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggagaacccagtgctgctcccacagatgtcaaggcgacaagtgtgtctgtgtcagagattcttgttgcatggaaacacattaaagagagtctaggaagaccacagggatttgaggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccctcctagtcaagcacctagcaacctcaggtgggagcagcaaggctctcaggtttctctgggctgggaacccgtcataccattagccaacgaatctgaagttgtgggttacaaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtggaaaaatcacaagtgcacagtcgacccttcactctctctccacatcttcgtcatcagtcaccttgctcttggcattgatgattccttcaacttcctggtga

SEQ ID NO: 13410 - DNA, 1090 bp, Artificial Sequence
  Synthetic polypeptide
gagtgtgggcgcgaggcagacggacgactcgcttattcacttctgctggaaggacaggacgtccgggaacgtggaagacgacttgatcatcttccctgacgactgtgagttcaagcgggtgccgcagtgccccagcgggagggtctacgtgctgaagttcaaggcagggtccaagcggcttttcttctggatgcaggaacccaagacagaccaggatgaggagcattgccggaaagtcaacgagtatctgaacaaccccccgatgcctggggcgctgggggccagcggaagcagcggccacgaactctctgcgctaggcggtgagggtggcctgcagagcctgctgggaaacatgagccacagccagctcatgcagctcatcggaccagccggccttggaggactgggtgggctgggggccctgactggacctggcctggccagcttactggggagcagtgggcctccagggagcagctcctcctccagctcccggagccagtcggcagcggtcaccccgtcatccaccacctcttccacccgtgccaccccagccccttctgctccagcagctgcctcagcaactagcccgagccccgcgcccagttccgggaatggagccagcacagcagccagcccgacccagcccatccagctgagcgacctccagagcatcctggccacgatgaacgtaccagccgggccagcaggcggccagcaagtggacctggccagtgtgctgacgccggagataatggctcccatcctcgccaacgcggatgtccaggagcgcctgcttccctacttgccatctggggagtcgctgccgcagaccgcggatgagatccagaataccctgacctcgccccagttccagcaggccctgggcatgttcagcgcagccttggcctcggggcagctgggccccctcatgtgccagttcggtctgcctgcagaggctgtggaggccgccaacaagggcgatgtggaagcgtttgccaaagccatgcagaacaacgccaagcccgagcagaaagagggcgacacgaaggacaagaaggacgaagaggaggacatgagcctggactga

SEQ ID NO: 13411 - DNA, 1151 bp, Artificial Sequence
  Synthetic polypeptide
ggtgggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtga

SEQ ID NO: 13412 - DNA, 373 bp, Artificial Sequence
  Synthetic polypeptide
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactag

SEQ ID NO: 13413 - DNA, 88 bp, Artificial Sequence
  Synthetic polypeptide
gcgcgcggcggcccctgataaggtgaagaagggcggcccggggagcgagtgcgctgagtgggcctgggggccctgcacccccagcagc

SEQ ID NO: 13414 - DNA, 335 bp, Artificial Sequence
  Synthetic polypeptide
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaag

SEQ ID NO: 13415 - DNA, 412 bp, Artificial Sequence
  Synthetic polypeptide
gcgcgcggcggcccctgataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccccgcctgtga

SEQ ID NO: 13416 - DNA, 1319 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtag

SEQ ID NO: 13417 - DNA, 1685 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 13418 - DNA, 1535 bp, Artificial Sequence
  Synthetic polypeptide
tatctagtctatgatccaaaaagtttcactcctaggtatttacccaagagaaatgagaatatatgtctgcaaaaagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatga

SEQ ID NO: 13419 - DNA, 637 bp, Artificial Sequence; identical to SEQ ID NO: 11967
  Synthetic polypeptide

SEQ ID NO: 13420 - DNA, 2521 bp, Artificial Sequence; identical to SEQ ID NO: 11968
  Synthetic polypeptide

SEQ ID NO: 13421 - DNA, 398 bp, Artificial Sequence; identical to SEQ ID NO: 6790
  Synthetic polypeptide

SEQ ID NO: 13422 - DNA, 391 bp, Artificial Sequence; identical to SEQ ID NO: 6791
  Synthetic polypeptide

SEQ ID NO: 13423 - DNA, 473 bp, Artificial Sequence; identical to SEQ ID NO: 6792
  Synthetic polypeptide

SEQ ID NO: 13424 - DNA, 756 bp, Artificial Sequence
  Synthetic polypeptide
gtggagcctttaaaaggtgattgagtcatgaaggctctgtccccttggatggattaatccactcatggatgaatgggttaatgggttatcactggagtgggttagtcagcacaagcagggtctgttataaaagctagtttggctcatgctccagccctctctctgtgcgatgccctgcacctcctcagcactctgcagggtccccaccagcaagaagaatttgaccttggatttctcggcctcctgaatgggctgattgttgtgacattggccgtatgctggatgcccaaccagattcggaggatcatggctgcggccaaacccaagcacgactggacgaggtcctacttccgggcgtacatgatcctcctccccttctcggagacgtttttctacctcagctcggtcatcaacccgctcctgtacacggtgtcctcgcagcagtttcggcgggtgttcgtgcaggtgctgtgctgccgcctgtcgctgcagcacgccaaccacgagaagcgcctgcgcgtacatgcgcactccaccaccgacagcgcccgctttgtgcagcgcccgttgctcttcgcgtcccggcgccagtcctctgcaaggagaactgagaagattttcttaagcacttttcagagcgaggccgagccccagtctaagtcccagtcattgagtctcgagtcactagagcccaactcaggcgcgaaaccagccaattctgctgcagagaatggttttcaggagcatgaagtttga

SEQ ID NO: 13425 - DNA, 477 bp, Artificial Sequence; identical to SEQ ID NO: 8538
  Synthetic polypeptide

SEQ ID NO: 13426 - DNA, 820 bp, Artificial Sequence
  Synthetic polypeptide
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatag

SEQ ID NO: 13427 - DNA, 420 bp, Artificial Sequence
  Synthetic polypeptide
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccagctttgcacacgccgcttcctctgcctggggcactttttctctcctttttgtagctcattctccgtcctccgtcagatgtcaccttcacccttccctacccctcctcttctgggcccacaaccctagtgcagccct

SEQ ID NO: 13428 - DNA, 700 bp, Artificial Sequence
  Synthetic polypeptide
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctgaccatcaagtctctggcggacattgaggaggagtataactacggcttcgtggtggagaagaccgcggctgcccgcctgccccccagcgtctcatag

SEQ ID NO: 13429 - DNA, 820 bp, Artificial Sequence
  Synthetic polypeptide
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaaggcctctgtgtccaagaagaaacgcatgtgtgtgaagctgttgcccctgggagccacggacacggctgtgtttgatgtccggctgagtgggaagaccaagacagtgcctggataccttcgaataggggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggcaggtctgcccagctcccggaacactctgaaagccgcacgccaaacccatatcaggtgcctggagtctggaggttttggctgcagccccaggaccagccttgccctgcgcctcacctga

SEQ ID NO: 13430 - DNA, 598 bp, Artificial Sequence
  Synthetic polypeptide
cagacgcggtggtacatgcctgtaatcccaacacttaggcaggaggatcactcgagcccagaagatcaagactagtgtgagcaacaaaatctcctgcaccgtcgagggggcacccgccagctttggcaagagcttcgcgcagaaatctggctacttcctgtgccttagttctctgggcagcctagagaacccgcaggagaacgtggtggccgatatccagatcgtggtggacaagagccccctgccgctgggcttctcccccgtctgcgaccccatggattccaggacatgggcggctttgccatctggtgcaagaaggccaaggccccgaggccagtgcccaagccccgaggtctcagccgggacatgcagggcctctctctggatgcagccagccagccaagtaagggcggcctcctggagcggacagcgtcaaggctgggctctcgggcatccactctgcggaggaatgactccatctacgaggcctccagcctctatggcatctcagccatggatggggttcccttcacactccacccacgatttgagggcaagagctgcagccccctggccttctctgcttttggggacctga

SEQ ID NO: 13431 - DNA, 711 bp, Artificial Sequence; identical to SEQ ID NO: 7220
  Synthetic polypeptide

SEQ ID NO: 13432 - DNA, 447 bp, Artificial Sequence; identical to SEQ ID NO: 7221
  Synthetic polypeptide

SEQ ID NO: 13433 - DNA, 1530 bp, Artificial Sequence; identical to SEQ ID NO: 7222
  Synthetic polypeptide

SEQ ID NO: 13434 - DNA, 747 bp, Artificial Sequence
  Synthetic polypeptide
cctccagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagatgaatcagcagatggctggcatgagtatcagtagtgcaacccctactgcaggttttggccagccctccagcacaacagcaggatggtctggaagctcatcaggtcagactctcagcacacaactgtggaaatga

SEQ ID NO: 13435 - DNA, 735 bp, Artificial Sequence
  Synthetic polypeptide
cctccagatggccctgctgtggcaccagtgaccaacgggaacacaacggtgccacccctgaacgatgatctggacatctttggaccgatgatttctaatcccttacctgcaactgtcatgcccccagctcaggggacaccctctgcaccagcagctgcaaccctgtctacagtaacatctggggatctagatttattcactgagcaaactacaaaatcagaagaagtggcaaagaaacaactttccaaagactccatcttatctctgtatggcacaggaaccattcaacagcaaagtactcctggtgtatttatgggacccacaaatataccatttacctcacaagcaccagctgcatttcagggctttccatcgatgggcgtgcctgtgcctgcagctcctggccttataggaaatgtgatgggacagagtccaagcatgatggtgggcatgcccatgcccaatgggtttatgggaaatgcacaaactggtgtgatgccacttcctcagaacgttgttggcccccaaggaggaatggtgggacaaatgggtgcaccccagagtaagtttggcctgccgcaagctcagcagccccagtggagcctctcacagataatgcagaagggtgatgctgttctccagcactccatcagtgcaatctactggccaatgacaaggtggttaaaatgtcctttagtagatgaatcagcagatggctggcatgagtatcagtag

SEQ ID NO: 13436 - DNA, 470 bp, Artificial Sequence; identical to SEQ ID NO: 9114
  Synthetic polypeptide

SEQ ID NO: 13437 - DNA, 134 bp, Artificial Sequence; identical to SEQ ID NO: 9115
  Synthetic polypeptide

SEQ ID NO: 13438 - DNA, 6216 bp, Artificial Sequence
  Synthetic polypeptide
ctgggtgcagtggctcatgcctgtaatcccaccactttaggaggccgaggcagcctgatggcttgagctcaggagtttgagaccagcctgggcaacatgtacatctttgcagacgcttatgcccagtacctctggatcacgtttgacttctgcaacactcttcaaggcttttccatcccatttcgggcagctgatctcctcctacacagtaaggcctccaaccttctcttgggctttgacaggtcccaccccaacaagcagctgtggaagtcagatgactttggccagacctggatcatgattcaggaacatgtcaagtccttttcttggggaattgatccctatgacaaaccaaataccatctacattgaacgacatgaaccctctggctactccactgtcttccgaagtacagatttcttccagtcccgggaaaaccaggaagtgatccttgaggaagtgagagattttcagcttcgggacaagtacatgtttgctacaaaggtggtgcatctcttgggcagtgaacagcagtcttctgtccagctctgggtctcctttggccggaagcccatgagagcagcccagtttgtcacaagacatcctattaatgaatattacatcgcagatgcctccgaggaccaggtgtttgtgtgtgtcagccacagtaacaaccgcaccaatttatacatctcagaggcagaggggctgaagttctccctgtccttggagaacgtgctctattacagcccaggaggggccggcagtgacaccttggtgaggtattttgcaaatgaaccatttgctgacttccaccgagtggaaggattgcaaggagtctacattgctactctgattaatggttctatgaatgaggagaacatgagatcggtcatcacctttgacaaagggggaacctgggagtttcttcaggctccagccttcacgggatatggagagaaaatcaattgtgagctttcccagggctgttcccttcatctggctcagcgcctcagtcagctcctcaacctccagctccggagaatgcccatcctgtccaaggagtcggctccaggcctcatcatcgccactggctcagtgggaaagaacttggctagcaagacaaacgtgtacatctctagcagtgctggagccaggtggcgagaggcacttcctggacctcactactacacatggggagaccacggcggaatcatcacggctattgcccagggcatggaaaccaacgagctaaaatacagtaccaatgaaggggagacctggaaaacattcatcttctctgagaagccagtgtttgtgtatggcctcctcacagaacctggggagaagagcactgtcttcaccatctttggctcgaacaaagagaatgtccacagctggctgatcctccaggtcaatgccacggatgccttgggagttccctgcacagagaatgactacaagctgtggtcaccatctgatgagcgggggaatgagtgtttgctgggacacaagactgttttcaaacggcggaccccccatgccacatgcttcaatggagaggactttgacaggccggtggtcgtgtccaactgctcctgcacccgggaggactatgagtgtgacttcggtttcaagatgagtgaagatttgtcattagaggtttgtgttccagatccggaattttctggaaagtcatactcccctcctgtgccttgccctgtgggttctacttacaggagaacgagaggctaccggaagatttctggggacacttgtagcggaggagatgttgaagcgcgactggaaggagagctggtcccctgtcccctggcagaagagaacgagttcattctgtatgctgtgaggaaatccatctaccgctatgacctggcctcgggagccaccgagcagttgcctctcaccgggctacgggcagcagtggccctggactttgactatgagcacaactgtttgtattggtccgacctggccttggacgtcatccagcgcctctgtttgaatggaagcacagggcaagaggtgatcatcaattctggcctggagacagtagaagctttggcttttgaacccctcagccagctgctttactgggtagatgcaggcttcaaaaagattgaggtagctaatccagatggcgacttccgactcacaatcgtcaattcctctgtgcttgatcgtcccagggctctggtcctcgtgccccaagagggggtgatgttctggacagactggggagacctgaagcctgggatttatcggagcaatatggatggttctgctgcctatcacctggtgtctgaggatgtgaagtggcccaatggcatctctgtggacgaccagtggatttactggacggatgcctacctggagtgcatagagcggatcacgttcagtggccagcagcgctctgtcattctggacaacctcccgcacccctatgccattgctgtctttaagaatgaaatctactgggatgactggtcacagctcagcatattccgagcttccaaatacagtgggtcccagatggagattctggcaaaccagctcacggggctcatggacatgaagattttctacaaggggaagaacactggaagcaatgcctgtgtgcccaggccatgcagcctgctgtgcctgcccaaggccaacaacagtagaagctgcaggtgtccagaggatgtgtccagcagtgtgcttccatcaggggacctgatgtgtgactgccctcagggctatcagctcaagaacaatacctgtgtcaaacaagagaacacctgtcttcgcaaccagtatcgctgcagcaacgggaactgtatcaacagcatttggtggtgtgactttgacaacgactgtggagacatgagcgatgagagaaactgccctaccaccatctgtgacctggacacccagtttcgttgccaggagtctgggacttgtatcccactgtcctataaatgtgaccttgaggatgactgtggagacaacagtgatgaaagtcattgtgaaatgcaccagtgccggagtgacgagtacaactgcagttccggcatgtgcatccgctcctcctgggtatgtgacggggacaacgactgcagggactggtctgatgaagccaactgtaccgccatctatcacacctgtgaggcctccaacttccagtgccgaaacgggcactgcatcccccagcggtgggcgtgtgacggggatacggactgccaggatggttccgatgaggatccagtcaactgtgagaagaagtgcaatggattccgctgcccaaacggcacttgcatcccatccagcaaacattgtgatggtctgcgtgattgctctgatggctccgatgaacagcactgcgagcccctctgtacgcacttcatggactttgtgtgtaagaaccgccagcagtgcctgttccactccatggtctgtgacggaatcatccagtgccgcgacgggtccgatgaggatgcggcgtttgcaggatgctcccaagatcctgagttccacaaggtatgtgatgagttcggtttccagtgtcagaatggagtgtgcatcagtttgatttggaagtgcgacgggatggatgattgcggcgattattctgatgaagccaactgcgaaaaccccacagaagccccaaactgctcccgctacttccagtttcggtgtgagaatggccactgcatccccaacagatggaaatgtgacagggagaacgactgtggggactggtctgatgagaaggattgtggagattcacatattcttcccttctcgactcctgggccctccacgtgtctgcccaattactaccgctgcagcagtgggacctgcgtgatggacacctgggtgtgcgacgggtaccgagattgtgcagatggctctgacgaggaagcctgccccttgcttgcaaacgtcactgctgcctccactcccacccaacttgggcgatgtgaccgatttgagttcgaatgccaccaaccgaagacgtgtattcccaactggaagcgctgtgacggccaccaagattgccaggatggccgggacgaggccaattgccccacacacagcaccttgacttgcatgagcagggagttccagtgcgaggacggggaggcctgcattgtgctctcggagcgctgcgacggcttcctggactgctcggacgagagcgatgaaaaggcctgcagtgatgagttgactgtgtacaaagtacagaatcttcagtggacagctgacttctctggggatgtgactttgacctggatgaggcccaaaaaaatgccctctgcttcttgtgtatataatgtctactacagggtggttggagagagcatatggaagactctggagacccacagcaataagacaaacactgtattaaaagtcttgaaaccagataccacgtatcaggttaaagtacaggttcagtgtctcagcaaggcacacaacaccaatgactttgtgaccctgaggaccccagagggattgccagatgcccctcgaaatctccagctgtcactccccagggaagcagaaggtgtgattgtaggccactgggctcctcccatccacacccatggcctcatccgtgagtacattgtagaatacagcaggagtggttccaagatgtgggcctcccagagggctgctagtaactttacagaaatcaagaacttattggtcaacactctatacaccgtcagagtggctgcggtgactagtcgtggaataggaaactggagcgattctaaatccattaccaccataaaaggaaaagtgatcccaccaccagatatccacattgacagctatggtgaaaattatctaagcttcaccctgaccatggagagtgatatcaaggtgaatggctatgtggtgaaccttttctgggcatttgacacccacaagcaagagaggagaactttgaacttccgaggaagcatattgtcacacaaagttggcaatctgacagctcatacatcctatgagatttctgcctgggccaagactgacttgggggatagccctctggcatttgagcatgttatgaccagaggggttcgcccacctgcacctagcctcaaggccaaagccatcaaccagactgcagtggaatgtacctggaccggcccccggaatgtggtttatggtattttctatgccacgtcctttcttgacctctatcgcaacccgaagagcttgactacttcactccacaacaagacggtcattgtcagtaaggatgagcagtatttgtttctggtccgtgtagtggtaccctaccaggggccatcctctgactacgttgtagtgaagatgatcccggacagcaggcttccaccccgtcacctgcatgtggttcatacgggcaaaacctccgtggtcatcaagtgggaatcaccgtatgactctcctgaccaggacttgttgtatgcagttgcagtcaaagatctcataagaaagactgacaggagctacaaagtaaaatcccgtaacagcactgtggaatacacccttaacaagttggagcctggcgggaaataccacatcattgtccaactggggaacatgagcaaagattccagcataaaaattaccacagtttcattatcagcacctgatgccttaaaaatcataacagaaaatgatcatgttcttctgttttggaaaagcctggctttaaaggaaaagcattttaatgaaagcaggggctatgagatacacatgtttgatagtgccatgaatatcacagcttaccttgggaatactactgacaatttctttaaaatttccaacctgaagatgggtcataattacacgttcaccgtccaagcaagatgcctttttggcaaccagatctgtggggagcctgccatcctgctgtacgatgagctggggtctggtgcagatgcatctgcaacgcaggctgccagatctacggatgttgctgctgtggtggtgcccatcttattcctgatactgctgagcctgggggtggggtttgccatcctgtacacgaagcaccggaggctgcagagcagcttcaccgccttcgccaacagccactacagctccaggctggggtccgcaatcttctcctctggggatgacctgggggaagatgatgaagatgcccctatgataactggattttcagatgacgtccccatggtgatagcctga

SEQ ID NO: 13439 - DNA, 1317 bp, Artificial Sequence; identical to SEQ ID NO: 7058
  Synthetic polypeptide

SEQ ID NO: 13440 - DNA, 217 bp, Artificial Sequence
  Synthetic polypeptide
ggccgggtgtggtggctcacacccgtaatcccaagactttaggaggctgagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 13441 - DNA, 440 bp, Artificial Sequence
  Synthetic polypeptide
ggccgggtgtggtggctcacacccgtaatcccaagactttaggaggctgagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 13442 - DNA, 298 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagatgaggaagctgagtcagctacgggcaagcgggcagctgaagatgatgaggatgacgatgtcgataccaagaagcagaagaccgacgaggatgactag

SEQ ID NO: 13443 - DNA, 952 bp, Artificial Sequence; identical to SEQ ID NO: 6966
  Synthetic polypeptide

SEQ ID NO: 13444 - DNA, 754 bp, Artificial Sequence; identical to SEQ ID NO: 6967
  Synthetic polypeptide

SEQ ID NO: 13445 - DNA, 450 bp, Artificial Sequence; identical to SEQ ID NO: 6968
  Synthetic polypeptide

SEQ ID NO: 13446 - DNA, 1484 bp, Artificial Sequence
  Synthetic polypeptide
ggccgagtgggagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctag

SEQ ID NO: 13447 - DNA, 316 bp, Artificial Sequence; identical to SEQ ID NO: 8692
  Synthetic polypeptide

SEQ ID NO: 13448 - DNA, 1265 bp, Artificial Sequence
  Synthetic polypeptide
ggaagcagacagacaggaagggaaaacacaatgcaacagaaggagagattgaagtgttggcagctgcaagccaagaaacacctgggttaccagaagctagaagaagaaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctga

SEQ ID NO: 13449 - DNA, 1154 bp, Artificial Sequence
  Synthetic polypeptide
ggaagcagacagacaggaagggaaaacacaatgcaacagaaggagagattgaagtgttggcagctgcaagccaagaaacacctgggttaccagaagctagaagaagaaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaagtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctga

SEQ ID NO: 13450 - DNA, 2619 bp, Artificial Sequence
  Synthetic polypeptide
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactga

SEQ ID NO: 13451 - DNA, 840 bp, Artificial Sequence
  Synthetic polypeptide
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctga

SEQ ID NO: 13452 - DNA, 543 bp, Artificial Sequence
  Synthetic polypeptide
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacattga

SEQ ID NO: 13453 - DNA, 781 bp, Artificial Sequence
  Synthetic polypeptide
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccag

SEQ ID NO: 13454 - DNA, 363 bp, Artificial Sequence
  Synthetic polypeptide
ggccgggcgcggtggctcacgcctgtaatcccagcactttgggaggccgaggtgggtggatcacctgaggtcaagagttcgagaccagcctggacaacatggtgaaaccttgtctctactaaaaatacaaaaaaaaaaaaaaaattagctggttgtggtggcacgcgcctgtagtcccagctactgggggaggctgagacagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagtttcagcgtga

SEQ ID NO: 13455 - DNA, 4908 bp, Artificial Sequence; identical to SEQ ID NO: 11516
  Synthetic polypeptide

SEQ ID NO: 13456 - DNA, 4611 bp, Artificial Sequence; identical to SEQ ID NO: 11517
  Synthetic polypeptide

SEQ ID NO: 13457 - DNA, 5142 bp, Artificial Sequence; identical to SEQ ID NO: 11518
  Synthetic polypeptide

SEQ ID NO: 13458 - DNA, 777 bp, Artificial Sequence; identical to SEQ ID NO: 11519
  Synthetic polypeptide

SEQ ID NO: 13459 - DNA, 755 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13460 - DNA, 755 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13461 - DNA, 1061 bp, Artificial Sequence
  Synthetic polypeptide
ttccccaaacacgcggccctgagcctccggtgctttgcgaaagccgtcccctccggctggaatgttctttgtctctctggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctga

SEQ ID NO: 13462 - DNA, 944 bp, Artificial Sequence
  Synthetic polypeptide
ttccccaaacacgcggccctgagcctccggtgctttgcgaaagccgtcccctccggctggaatgttctttgtctctctggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccagaaaacgctgccgcggtccacagtgtcgattctggatgaccacattagccactatccacagctag

SEQ ID NO: 13463 - DNA, 946 bp, Artificial Sequence
  Synthetic polypeptide
aagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 13464 - DNA, 1003 bp, Artificial Sequence
  Synthetic polypeptide
aagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgcagtgacttctatgttttgggttgatgctgaattagggagtgatatttaccttgatggtatcataactattgtggattcaaaatatggattaaaacatttaacagaagagaaacctgatggccttatcaatgaagctactaggcaagttgctttggcagatatcattctcattaataaaacagacttggttccagaagaagatgtaaagaaattaagaacgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctcattggcagaaatttagataaggatatccttaaacagctgtttatagctactgtgacagaaacagaaaagcagtggacaacacatttcaaagaagatcaagtttgtacataa

SEQ ID NO: 13465 - DNA, 2738 bp, Artificial Sequence
  Synthetic polypeptide
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaa

SEQ ID NO: 13466 - DNA, 629 bp, Artificial Sequence
  Synthetic polypeptide
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagacggagtctcgttctgtcaccaggctggagtgcaggcgcgtgatctag

SEQ ID NO: 13467 - DNA, 918 bp, Artificial Sequence
  Synthetic polypeptide
tctcccgtcatgctgttttattttctagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcagtaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaa

SEQ ID NO: 13468 - DNA, 1151 bp, Artificial Sequence
  Synthetic polypeptide
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggaaaagcgcctcctccgccgctcccgctcgggggacgtgctggccaagaaccctgtggtgcgctccaagagctacaacacgcctctgctgaaccccgtgcaggagcacgaggcggagggcgcggcggccggcggtaccagcatccgcaggcactctgtgtcggagatgacgtcctgccccgagcctcagggcttctccgacccgcccggccagggccccaccgggaccttcaggtcctccccggcgccccactcagggccctgccccagcagactgtaccccacgacccagccccctgagcagggcttggatcccacccgcagctccctgccccgctccagcccggagaacctggtggaccagatcctggagtccgtggactcggattctgaagggattttcattgactttggccggggccggggctctggcatgtccgacttggagggctctgggggccggcagagtgtcgtgtga

SEQ ID NO: 13469 - DNA, 516 bp, Artificial Sequence
  Synthetic polypeptide
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggcatctgcccgcgccagtcaggcccagtggtgatggcccccatgcccacaggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtga

SEQ ID NO: 13470 - DNA, 353 bp, Artificial Sequence
  Synthetic polypeptide
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggaagctgctggactcactggcagagacctgggacttcttcttcagtga

SEQ ID NO: 13471 - DNA, 1679 bp, Artificial Sequence
  Synthetic polypeptide
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 13472 - DNA, 1916 bp, Artificial Sequence
  Synthetic polypeptide
ggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctag

SEQ ID NO: 13473 - DNA, 1896 bp, Artificial Sequence; identical to SEQ ID NO: 8628
  Synthetic polypeptide

SEQ ID NO: 13474 - DNA, 1803 bp, Artificial Sequence; identical to SEQ ID NO: 8629
  Synthetic polypeptide

SEQ ID NO: 13475 - DNA, 1014 bp, Artificial Sequence; identical to SEQ ID NO: 8630
  Synthetic polypeptide

SEQ ID NO: 13476 - DNA, 1816 bp, Artificial Sequence
  Synthetic polypeptide
ttaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggatgctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctga

SEQ ID NO: 13477 - DNA, 577 bp, Artificial Sequence
  Synthetic polypeptide
ttaggtgtttgttagagtttcttaaaattggagagactataactcatttgattttcctcctaaagtggttttctgagtccatatcccagtgaaggacacctccgttcttccattgactcaggccaagaaccttggagacctccttaaatcctttttctctcacaccccacatccaacttagctaccagtcctgtcatccctctccaggatctggccacctctcaccatttccactgctaccaccaggtccacagcatcattgtctcctgaatgattgggacagcctcctaactagtccattggcttctttctgccatatccacctctaaccacctctccacccagcagccagagtgctcctttccagcaaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagagga

SEQ ID NO: 13478 - DNA, 778 bp, Artificial Sequence
  Synthetic polypeptide
tttttttgtttgtttgtttggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtag

SEQ ID NO: 13479 - DNA, 466 bp, Artificial Sequence; identical to SEQ ID NO: 8369
  Synthetic polypeptide

SEQ ID NO: 13480 - DNA, 526 bp, Artificial Sequence; identical to SEQ ID NO: 8370
  Synthetic polypeptide

SEQ ID NO: 13481 - DNA, 319 bp, Artificial Sequence; identical to SEQ ID NO: 8371
  Synthetic polypeptide

SEQ ID NO: 13482 - DNA, 520 bp, Artificial Sequence; identical to SEQ ID NO: 8372
  Synthetic polypeptide

SEQ ID NO: 13483 - DNA, 1346 bp, Artificial Sequence; identical to SEQ ID NO: 7758
  Synthetic polypeptide

SEQ ID NO: 13484 - DNA, 902 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctga

SEQ ID NO: 13485 - DNA, 266 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctga

SEQ ID NO: 13486 - DNA, 591 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaac

SEQ ID NO: 13487 - DNA, 612 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaaga

SEQ ID NO: 13488 - DNA, 203 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgagacagagtttcaccatgttggccaggatggtcttgatctgacctcgtga

SEQ ID NO: 13489 - DNA, 263 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaaggtgagggggaaagagaccgaggccttgccaggagtcctagtctgtggattcctgatgagttcgacaatgatccaattctggtacagcagttgcgccggacatacaaatatttcaaagattatagacagatga

SEQ ID NO: 13490 - DNA, 536 bp, Artificial Sequence
  Synthetic polypeptide
ggccgggcacggtggctcacgcctgtaatcccagcactttgggaggccgaggcgggcggatcacgaggtcaggagacggagaccatcctggctaacacggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaag

SEQ ID NO: 13491 - DNA, 890 bp, Artificial Sequence
  Synthetic polypeptide
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 13492 - DNA, 467 bp, Artificial Sequence
  Synthetic polypeptide
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctga

SEQ ID NO: 13493 - DNA, 347 bp, Artificial Sequence
  Synthetic polypeptide
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctgggtccggggatcccgagctgtcctgcagctgtaccctga

SEQ ID NO: 13494 - DNA, 467 bp, Artificial Sequence
  Synthetic polypeptide
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcaggtccggggatcccgagctgtcctgcagctgtaccctgagaactcagagcagttggagctga

SEQ ID NO: 13495 - DNA, 941 bp, Artificial Sequence
  Synthetic polypeptide
gccaggtgggagtggctcacgcgtgtaatctcagcaatcgcagcactttgggaggctgaggcgggaggatcgcttgagctcaggggttcgagaccagcctgggcaacgtagcgagcccccgtctccgcaactcacggatgattgatatccagaccaggatggctgggcgagcattggagcttctttatctgccagagaataagccctgttacctgctggatattggctgtggcactgggctgagtggaagttatctgtcagatgaagggcactattgggtgggcctggatatcagccctgccatgctggatgaggctgtggaccgagagatagagggagacctgctgctgggggatatgggccagggcatcccattcaagccaggcacatttgatggttgcatcagcatttctgctgtgcagtggctctgtaatgctaacaagaagtctgaaaaccctgccaagcgcctgtactgcttttttgcttctcttttttctgttctcgtccggggatcccgagctgtcctgcagctgtaccctgagaactcagagcagttggagctgatcacaacccaggccacaaaggcaggcttctccggtggcatggtggtagactaccctaacagtgccaaagcaaagaaattctacctctgcttgttttctgggccttcgacctttataccagaggggctgagtgaaaatcaggatgaagttgaacccagggagtctgtgttcaccaatgagagggaaggtggagcatttgagagaaggggcatccgaggccaccagactcggaggttcccattaaggatgtcgaggcggggaatggtgaggaagagtcgggcatgggtgctggagaagaaggagcggcacaggcgccagggcagggaagtcagacctgacacccagtacaccggccgcaagcgcaagccccgcttctaa

SEQ ID NO: 13496 - DNA, 215 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaa

SEQ ID NO: 13497 - DNA, 441 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13498 - DNA, 444 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctgagaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13499 - DNA, 432 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagagacgcccctgctaacgggaatgctaatgaggaaaatggggagcaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13500 - DNA, 634 bp, Artificial Sequence
  Synthetic polypeptide
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactga

SEQ ID NO: 13501 - DNA, 367 bp, Artificial Sequence
  Synthetic polypeptide
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttga

SEQ ID NO: 13502 - DNA, 612 bp, Artificial Sequence
  Synthetic polypeptide
ctcgctccctctcctttcagctctactccgacgtcactccttcccagacgaccttattatccacgcgatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 13503 - DNA, 1446 bp, Artificial Sequence; identical to SEQ ID NO: 8572
  Synthetic polypeptide

SEQ ID NO: 13504 - DNA, 104 bp, Artificial Sequence; identical to SEQ ID NO: 8573
  Synthetic polypeptide

SEQ ID NO: 13505 - DNA, 489 bp, Artificial Sequence; identical to SEQ ID NO: 8574
  Synthetic polypeptide

SEQ ID NO: 13506 - DNA, 1196 bp, Artificial Sequence
  Synthetic polypeptide
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctcccagacaacatcccttgtatccctccatcatccgtggactccacagacagtttcttcccctccaggaagcctccaatgtctgaaaagtcaagagcccaagtagcttcagaaaatggtgggaggtgggcatggcccatgccaggctggggtcctgcctgccctaagaagatgccgaactgctctcccactgcaaagaatgctgtctatgaggaggatgagctggaggaggagcccaggagcactggggagctgaggctctgggattaccggctcctcaaggtcttctttgtgctgatctgcttcctggtcatgtcctcatcctacctggcgttccgtatttctcggctagagcagcagttatgctccttgagttgggatgacccagtccctgggcacaggtaa

SEQ ID NO: 13507 - DNA, 794 bp, Artificial Sequence
  Synthetic polypeptide
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtctgcacccacctacagccttccagcaagaagagtctgagtgtaagagaattttcaggggaacctgagtctctggaagtcctcatccctgagatgaagtggagaaaggtatgcccttcctccaggtccctgtctctc

SEQ ID NO: 13508 - DNA, 660 bp, Artificial Sequence
  Synthetic polypeptide
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaagtatatctttgtgtcactgctctcccgggacagtgtatatgacctgctgaggagagtct

SEQ ID NO: 13509 - DNA, 602 bp, Artificial Sequence
  Synthetic polypeptide
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtctgcactggccagaaggcttgaagggtgaagagataaagaagtgtggccgagaagggataacactgaataaatacaaccagcaataccacaagctgtttaaggatgttcccttggaggaagtggttctcaaagtgtgttcctgtgccctccagagggacttcctcctccagggccggctctacatctcccccaactggctctgcttccatgccagcctctttggcaaggatatcaaggtggtcattcctgtggtgtctgtgcaaatgatcaaaaaacacaagatggcacggctccttcccaatggactggccatcaccaccaacaccagccagaag

SEQ ID NO: 13510 - DNA, 311 bp, Artificial Sequence
  Synthetic polypeptide
tacaaatgaagaaagaacttcaatacaaatgaagaaagaatttcacctgtgaattctctataagacaatgaacttccagtggttaataattatttggaaaaaactgttcaacctaccagtaagcagaaatacaaatgaagacaacgtattttcacctatcagatttgcaaagcaaccaacaaatgcacagaaagacagcttctctgaacagtcctgtgtcctgcaaagagaaaccagacagagttgaggagcccccggactacagtgccatccccctctcccagtgtggtagcctcagccaggtcaggtga

SEQ ID NO: 13511 - DNA, 755 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13512 - DNA, 755 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaatgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13513 - DNA, 1242 bp, Artificial Sequence
  Synthetic polypeptide
ggttgggcacagtggcttatgcttgtaatcccagcactttgggaggtcaaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggacacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtag

SEQ ID NO: 13514 - DNA, 950 bp, Artificial Sequence; identical to SEQ ID NO: 8419
  Synthetic polypeptide

SEQ ID NO: 13515 - DNA, 525 bp, Artificial Sequence
  Synthetic polypeptide
gacttgggaatcaggtcccagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatga

SEQ ID NO: 13516 - DNA, 351 bp, Artificial Sequence
  Synthetic polypeptide
gacttgggaatcaggtcccagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggccagcagcaacacccacagcctgtttgagagtggcatcaattggggccgtgtggtggctcttctgggcttcggctaccgtctggccctacacgtctaccagcatggcctga

SEQ ID NO: 13517 - DNA, 533 bp, Artificial Sequence
  Synthetic polypeptide
gtcaggcgtccgggttcgaacccggcccagccccggccttgcagggcaacgtctggccctggcttcctcctttggaaagtggcgttcgcgacggtgccggctcggggttattgctaaattgagcgcgatgattcaggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaa

SEQ ID NO: 13518 - DNA, 2535 bp, Artificial Sequence; identical to SEQ ID NO: 6677
  Synthetic polypeptide

SEQ ID NO: 13519 - DNA, 2181 bp, Artificial Sequence; identical to SEQ ID NO: 6678
  Synthetic polypeptide

SEQ ID NO: 13520 - DNA, 1119 bp, Artificial Sequence; identical to SEQ ID NO: 6679
  Synthetic polypeptide

SEQ ID NO: 13521 - DNA, 205 bp, Artificial Sequence; identical to SEQ ID NO: 12409
  Synthetic polypeptide

SEQ ID NO: 13522 - DNA, 154 bp, Artificial Sequence; identical to SEQ ID NO: 12410
  Synthetic polypeptide

SEQ ID NO: 13523 - DNA, 341 bp, Artificial Sequence
  Synthetic polypeptide
aaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggccccctgtgcccggagagtgtgtcatttccagaggttcaccatgtttctgcatagacgtctgtcctcactggctgctcctcctagcgttcagttctggaaggcacggggaactcaccaactctaa

SEQ ID NO: 13524 - DNA, 536 bp, Artificial Sequence
  Synthetic polypeptide
aaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggccacatctaacagcttctttctgtttcatcccatggttgaccttgtctaagccccctgtgcccggagagtgtgtcatttccagaggttcaccatgtttctgcatagacgtctgtcctcactggctgctcctcctagcgttcagttctggaaggcacggggaactcaccaactctaaaacacttccaatatatgctgaggtacaaagggccgtcttgtttccgttccagcaggctgagggcaccctggacacgttcagaacacccgctgtgtctgttgtgtttcctctttgccaatttgaaaggaaaaagtcattttga

SEQ ID NO: 13525 - DNA, 276 bp, Artificial Sequence
  Synthetic polypeptide
ggccaggcgcagtggctcacacctgtaatcccagcactttgggaggctgaggcaggcggatcatgaggtcaggagatcgagaccatcctggctaacatgcgcccctttcctgtgtctgacagcgagtcaccaacagcacgcctttacagctgcgtgaggagagccccgtggatcccgcacaggggtacccgtgtccgcttgcgccgtcggaccttgtggactcgattgctctgcaccagggttgatttcctccattccttacgccctctgccatga

SEQ ID NO: 13526 - DNA, 1643 bp, Artificial Sequence; identical to SEQ ID NO: 7549
  Synthetic polypeptide

SEQ ID NO: 13527 - DNA, 1457 bp, Artificial Sequence; identical to SEQ ID NO: 7550
  Synthetic polypeptide

SEQ ID NO: 13528 - DNA, 134 bp, Artificial Sequence
  Synthetic polypeptide
gaggaggagccaagatggccgaataggaacagctccggtctacagctcccagcgtgagcgacgcagaagacgggtgatttctgcatttccatctgagaacttcactgtatgccatacagcaacagagaaagtga

SEQ ID NO: 13529 - DNA, 740 bp, Artificial Sequence; identical to SEQ ID NO: 7794
  Synthetic polypeptide

SEQ ID NO: 13530 - DNA, 1389 bp, Artificial Sequence
  Synthetic polypeptide
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgctccccttgaactacccaaccagtggctctgggatattatcgatgagttcatctaccagtttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13531 - DNA, 1245 bp, Artificial Sequence
  Synthetic polypeptide
ggccaggcgcggtggctcatgcctgtaatcccagcactttgggaggtgaaggtggacggatcacgagatgctgtcttcctgattttatacaaagaattatactacaggcacatatatgccaaagtcagttttcagtcattcagtcagtaccgctgtaagactgccaagaagtcagaggaggagattgactttcttcgttccaatcccaaaatctggaatgttcatagtgtcctcaatgtccttcattccctggtagacaaatccaacatcaaccgacagttggaggtatacacaagcggaggtgaccctgagagtgtggctggggagtatgggcggcactccctctacaaaatgcttggttacttcagcctggtcgggcttctccgcctgcactccctgttaggagattactaccaggccatcaaggtgctggagaacatcgaactgaacaagaagagtatgtattcccgtgtgccagagtgccaggtcaccacatactattatgttgggtttgcatatttgatgatgcgtcgttaccaggatgccatccgggtcttcgccaacatcctcctctacatccagaggaccaagagcatgttccagaggaccacgtacaagtatgagatgattaacaagcagaatgagcagatgcatgcgctgctggccattgccctcacgatgtaccccatgcgtattgatgagagcattcacctccagctgcgggagaaatatggggacaagatgttgcgcatgcagaaaggtgacccacaagtctatgaagaacttttcagttactcctgccccaagttcctgtcgcctgtagtgcccaactatgataatgtgcaccccaactaccacaaagagcccttcctgcagcagctgaaggtgttttctgatgaagtacagcagcaggcccagctttcaaccatccgcagcttcctgaagctctacaccaccatgcctgtggccaagctggctggcttcctggacctcacagagcaggagttccggatccagcttcttgtcttcaaacacaagatgaagaacctcgtgtggaccagcggtatctcagccctggatggtgaatttcagtcagcctcagaggttgacttctacattgataaggacatgatccacatcgcggacaccaaggtcgccaggcgttatggggatttcttcatccgtcagatccacaaatttgaggagcttaatcgaaccctgaagaagatgggacagagaccttga

SEQ ID NO: 13532 - DNA, 194 bp, Artificial Sequence
  Synthetic polypeptide
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacat

SEQ ID NO: 13533 - DNA, 216 bp, Artificial Sequence
  Synthetic polypeptide
ggccaggcgcggtggctcatgcctgtaatcccagcactttgggaggtgaaggtggacggatcacgagatgctgtcttcctgattttatacaaagaattatactacaggcacatatatgccaaagtcagtgggggaccttccttggagcagaggtttgaatcctattacaactactgcaatctcttcaactacattcttaatgccgatggtcctgct

SEQ ID NO: 13534 - DNA, 392 bp, Artificial Sequence
  Synthetic polypeptide
ggcccagcgcggtggcttagaggtataatcccagcactttggaggccgaggcgggcggatcacgaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagtcatagcacacatcggacatttggaaaacagcagtggcaacaactgtatgacacacttaatgcctggaaacaaaatctgaacaaagtgaaaaacagccttttgagtctttctgatacctga

SEQ ID NO: 13535 - DNA, 406 bp, Artificial Sequence
  Synthetic polypeptide
ggcccagcgcggtggcttagaggtataatcccagcactttggaggccgaggcgggcggatcacgaggcctgttacatgaacagaatatggcaaaaatgagactacttacttttatgggaatggcagtagaaaataaggaaatttcttttgacacaatgcagcaagaacttcagattggagctgatgatgttgaagcatttgttattgacgccgtaagaactaaaatggtctactgcaaaattgatcagacccagagaaaagtagttgtcagttgctcaggagaattagaaggcttaggatcaatatgtcatagcacacatcggacatttggaaaacagcagtggcaacaactgtatgacacacttaatgcctggaaacaaaatctgaacaaagtgaaaaacagcct

SEQ ID NO: 13536 - DNA, 1745 bp, Artificial Sequence
  Synthetic polypeptide
acccagcccagttcatggcttgtttggcagcaaccctgagacgctttacagtcctagaccctaaaaggtcaaaaggctgtcttattctcaatatacattttattacccaatctgctcctgacattaaataaaactccaaaaattaaattccagccctcaaaccccacaataagatttaattaacctcaccttcaaagtatacaataatagaaaaaagttgcaattccttgcctccactgtaagacaaaccccagccacatctccagcaaacaagaacttccaaacgcctgaaccacagcggccaggcattcctccagaacctcctcccccaggagcttcctacaagtgccagaaatctgaccaccaggccaaggaatgcccacagcccaggattcctcctaagccacatcccatctgtgcaggaccccactggaaatcagaatgttcaactcacttggcaaccactcccagagcccctggaactctggcccaaggctctctgactccttcccagatcttctcggcttagcagctgaagactgacaccgcctgatcgcctcagaagcctacaggaccaacacagacactaagtaactctcacagtagaagaggcctctctgactaaccacacagaaaccatcaccgtggaggaaggccagacgctcactctaaagtgtgtcacttctctgaggaagaactcctccctccagtggctgaccccctcagggttcaccatttttttaaatgagtatcctgctttaaaaaattccaaataccagcttcttcatcactcggccaatcagctctccatcactgtgcctaacgtaaccctgcaagatgaaggcgtgtacaagtgcttacattacagcgactctgtaagcacaaaggaagtgaaagtgattgtgctggcaactcctttcaagccaatcctggaagcttcagttatcagaaagcaaaatggagaagaacatgttgtactcatgtgctccaccatgagaagcaagccccctccgcagataacctggctacttgggaatagcatggaagtgtccggtggaacgctccatgaatttgaaactgatgggaagaaatgtaatactaccagcactctcataatccacacttatggcaaaaattcaacggtggactgcattatccgacacagaggcctgcaagggagaaaactagtagcacccttccggtttgaagatttggttactgatgaagagacagcttcagatgctctggagagaaactctctatcctctcaagacccacagcagcccaccagtactgtctcagtaacggaagattctagtacatcggagattgacaaggaagagaaagaacaaaccactcaagatcctgacttgaccaccgaagcaaatcctcagtatttaggactggcaagaaagaaaagtggcatcctgctgctcacgctggtgtccttcctcattttcatactcttcatcatagtccagctcttcatcatgaagctgaggaaagcacatgtgatatggaagaaagaaaacgaagtttcagaacacacactagaaagttacagatcaaggtcaaataatgaagaaacatcatctgaagagaaaaatggccaatcttcccaccctatgcgttgcatgaactacatcacaaagttgtactcagaagcaaaaacaaagaggaaggaaaatgtacaacattcaaaattagaagaaaagcacatccaagtaccagagagtattgtgtag

SEQ ID NO: 13537 - DNA, 2232 bp, Artificial Sequence; identical to SEQ ID NO: 9562
  Synthetic polypeptide

SEQ ID NO: 13538 - DNA, 834 bp, Artificial Sequence; identical to SEQ ID NO: 9563
  Synthetic polypeptide

SEQ ID NO: 13539 - DNA, 847 bp, Artificial Sequence; identical to SEQ ID NO: 9564
  Synthetic polypeptide

SEQ ID NO: 13540 - DNA, 262 bp, Artificial Sequence
  Synthetic polypeptide
cagacttcctaccgggagcactgcagtcacttctgaacaggatattatcaactcactggtaacaacagtattcatgctcatcgtatctgtgttggcactgataccagaaaccacaacattgacagttggtggaggggtgtttgcacttgtgacagcagtatgctgtcttgccgacggggcccttatttaccggaagcttctgttcaatcccagcggtccttaccagaaaaagcctgtgcatgaaaaaaaagaagttttgtaa

SEQ ID NO: 13541 - DNA, 145 bp, Artificial Sequence
  Synthetic polypeptide
cagacttcctaccgggagcactgcagtcacttctgaacaggatattatcaactcactggtaacaacagtattcatgctcatcgtatctgtgttggcactgataccagaaaccacaacattgacagttggtggagggttattttaa

SEQ ID NO: 13542 - DNA, 844 bp, Artificial Sequence
  Synthetic polypeptide
ctcctctccccatgctcgttgcaccctgttctggcgaagggctgcgccatccacagcggcgctcaggccaggaccagggggtccttggtttcttcctctccctccctcaacacatagcctgttcccagggttctagctttgtctccctgttgctactgccagggctctggtctggccaccatcatcttctcccgactctgtccacagcctcctccctgtctccccgtctccacgccattctcttccacatgtagccagagggacctttctaaaacgcacatctggctacttccctccactccacaaatccttcgggacgccctgtggcctgcaggacaaagccccacctctgcgggagtggcgtgtgaggctcttcaccaacgggccttgcccgccctgtgttctcctcctgcccgcccccacacatgccctgtgctccagccacacccagcgccttgcagtctaaggagagcccatgcctttggacatgctgttccttctgcctggaatttccttgtccgcctggtgaactcctcgttctgcaagactccgctcaaaacagcaccttcgagaagactgccctgccccttccctgccttgccccatgtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataa

SEQ ID NO: 13543 - DNA, 293 bp, Artificial Sequence
  Synthetic polypeptide
aggctgaagtggagagatcgcctgagcccaggaggtcaaggctacagtgagccgtgactgcaccactgcactccaccctgggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataa

SEQ ID NO: 13544 - DNA, 368 bp, Artificial Sequence
  Synthetic polypeptide
aggctgaagtggagagatcgcctgagcccaggaggtcaaggctacagtgagccgtgactgcaccactgcactccaccctgggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttga

SEQ ID NO: 13545 - DNA, 1657 bp, Artificial Sequence
  Synthetic polypeptide
ccgggtgcagtggctcacgcagtaatcctagcaatttgggaggccaagggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctga

SEQ ID NO: 13546 - DNA, 440 bp, Artificial Sequence
  Synthetic polypeptide
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtag

SEQ ID NO: 13547 - DNA, 437 bp, Artificial Sequence
  Synthetic polypeptide
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggtgcgttctacttgtacttcgttattccttagctatgtagatggagtgaagttttgctccccacaagcagaggtccagattccagccatgacagttactctgggcccttgcttctcagatatactttag

SEQ ID NO: 13548 - DNA, 566 bp, Artificial Sequence
  Synthetic polypeptide
gagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagagcaacttagtaaaagacaagtaagacaggagctggggaccatggaagaaacatcccatgtgctttatcgaagtgccaagttgggaccacgggccgggctagaacgatccatggaaaagttctgtgctcaggggaacaactcaaattcagacattttgctagggctaagggaaatgagctggtaccttcgaatcagcttccagaacgcctgcagtgcaagttctcaattacggcatgcaaatgatttccttaaaaattaa

SEQ ID NO: 13549 - DNA, 190 bp, Artificial Sequence
  Synthetic polypeptide
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactga

SEQ ID NO: 13550 - DNA, 77 bp, Artificial Sequence
  Synthetic polypeptide
gagtctcagagcccagattctagtcctgttaaagttccttacctgctgtatctctttcactgggcctgcctcaatga

SEQ ID NO: 13551 - DNA, 768 bp, Artificial Sequence
  Synthetic polypeptide
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctga

SEQ ID NO: 13552 - DNA, 400 bp, Artificial Sequence
  Synthetic polypeptide
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagctt

SEQ ID NO: 13553 - DNA, 371 bp, Artificial Sequence
  Synthetic polypeptide
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagcctt

SEQ ID NO: 13554 - DNA, 457 bp, Artificial Sequence
  Synthetic polypeptide
gagtctcagagcccagattctagtcctgttaaagttccttacctgctgtatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttga

SEQ ID NO: 13555 - DNA, 340 bp, Artificial Sequence; identical to SEQ ID NO: 12511
  Synthetic polypeptide

SEQ ID NO: 13556 - DNA, 116 bp, Artificial Sequence; identical to SEQ ID NO: 12512
  Synthetic polypeptide

SEQ ID NO: 13557 - DNA, 247 bp, Artificial Sequence; identical to SEQ ID NO: 12513
  Synthetic polypeptide

SEQ ID NO: 13558 - DNA, 307 bp, Artificial Sequence; identical to SEQ ID NO: 12514
  Synthetic polypeptide

SEQ ID NO: 13559 - DNA, 378 bp, Artificial Sequence
  Synthetic polypeptide
tgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcagaggggccgtatggggtctttgctggaagagatgcatccaggggccttgccacattttgcctggataaggaagcactgaaggatgagtacgatgacctttctgacctcactgctgcccagcaggagactctgagtgactgggagtctcagttcactttcaagtatcatcacgtgggcaaactgctgaaggagggggaggagcccactgtgtactcagatgaggaagaaccaaaagatgagagtgcccggaaaaatgattaa

SEQ ID NO: 13560 - DNA, 2373 bp, Artificial Sequence
  Synthetic polypeptide
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaa

SEQ ID NO: 13561 - DNA, 2208 bp, Artificial Sequence
  Synthetic polypeptide
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcagcacaccgttccggaaggcaaaagccttgtatgcctgcaaagctgaacatgactcagaactttcgttcacagcaggcacggtcttcgataacgttcacccatctcaggagcctggctggttggaggggactctgaacggaaagactggcctcatccctgagaattacgtggagttcctctaa

SEQ ID NO: 13562 - DNA, 512 bp, Artificial Sequence
  Synthetic polypeptide
gcatagagtagaagctgagagtgtgggctctggacgccgacagcatggcttccaatcctggcctgtccgtcacgtgtagttgatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 13563 - DNA, 487 bp, Artificial Sequence; identical to SEQ ID NO: 8443
  Synthetic polypeptide

SEQ ID NO: 13564 - DNA, 466 bp, Artificial Sequence; identical to SEQ ID NO: 8444
  Synthetic polypeptide

SEQ ID NO: 13565 - DNA, 411 bp, Artificial Sequence; identical to SEQ ID NO: 6630
  Synthetic polypeptide

SEQ ID NO: 13566 - DNA, 1775 bp, Artificial Sequence; identical to SEQ ID NO: 568
  Synthetic polypeptide

SEQ ID NO: 13567 - DNA, 1570 bp, Artificial Sequence
  Synthetic polypeptide
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaa

SEQ ID NO: 13568 - DNA, 808 bp, Artificial Sequence
  Synthetic polypeptide
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaa

SEQ ID NO: 13569 - DNA, 397 bp, Artificial Sequence
  Synthetic polypeptide
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaa

SEQ ID NO: 13570 - DNA, 765 bp, Artificial Sequence
  Synthetic polypeptide
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatgg

SEQ ID NO: 13571 - DNA, 1957 bp, Artificial Sequence
  Synthetic polypeptide
cctgggttcaaatcccgacactgccactggccaagctgtgtgatttggggccgcactcaacctctttggacctcggcttttgctttcgtggaacggggaccgctgacctgccccgcagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctagactctgagcctgggatgtgctttgagatccctccccggtggctggacctgactgttgtgaaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaa

SEQ ID NO: 13572 - DNA, 644 bp, Artificial Sequence
  Synthetic polypeptide
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataa

SEQ ID NO: 13573 - DNA, 719 bp, Artificial Sequence
  Synthetic polypeptide
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttga

SEQ ID NO: 13574 - DNA, 497 bp, Artificial Sequence
  Synthetic polypeptide
ccccctgctgtcccttctccccacagcagccagagccgtcctttggaagcatcaggtcttgtcactctttacctcaaaacttgacagtggctccatgaatcacgcccagtgaaaaccaaggtcaacacttgatctgccaggccgtctgtggtctggtcccggatcccagctgctgtccctcccctgctccctgcccttcagccacagtggcccctttgcttttccccctgaacataccggatgcttgcccaccccagggcttttgtgcttgctcttggtgctgtctggaacactccccagaaaccggcatggctaactccctcatttccttcagatgtctactcactattgccttggcagaggtggaggagacactgaagcgactgcagagccagaagggagtgcagggaatcatcgtcgtgaacacagaaggaggctgggagcccttgggacactgtggagacaggagcaggccccctgctcagggctgcccctga

SEQ ID NO: 13575 - DNA, 1052 bp, Artificial Sequence; identical to SEQ ID NO: 12532
  Synthetic polypeptide

SEQ ID NO: 13576 - DNA, 473 bp, Artificial Sequence
  Synthetic polypeptide
gatcattttttaggctgtttcacaaggcattcctgcatcagtggcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctga

SEQ ID NO: 13577 - DNA, 612 bp, Artificial Sequence
  Synthetic polypeptide
tattttaaaactattattattttaatcattaaaaagcccgaaatgtttgagacggcgattaaggagagcacctcctctaagagccctcccagaaaaataaattcatcacccaatgttaatactactgcatcaggtgttgaagaccttaacatcattcaggtgacaattccagatgatgataatgaaagactctcgaaagttgaaaaagctagacagctaagagaacaagtgaatgacctctttagtcggaaatttggtgaagctattggtatgggttttcctgtgaaagttccctacaggaaaatcacaattaaccctggctgtgtggtggttgatggcatgcccccgggggtgtccttcaaagcccccagctacctggaaatcagctccatgagaaggatcttagactctgccgagtttatcaaattcacggtcattagaccatttccaggacttgtgattaataaccagctggttgatcagagtgagtcagaaggccccgtgatacaagaatcagctgaaccaagccagttggaagttccagccacagaagaaataaaagagactgatggaagctctcagatcaagcaagaaccagaccccacgtggtag

SEQ ID NO: 13578 - DNA, 218 bp, Artificial Sequence; identical to SEQ ID NO: 6903
  Synthetic polypeptide

SEQ ID NO: 13579 - DNA, 2471 bp, Artificial Sequence; identical to SEQ ID NO: 576
  Synthetic polypeptide

SEQ ID NO: 13580 - DNA, 340 bp, Artificial Sequence; identical to SEQ ID NO: 8550
  Synthetic polypeptide

SEQ ID NO: 13581 - DNA, 1079 bp, Artificial Sequence
  Synthetic polypeptide
gcagggtgcggtggctcacccctgtaattccagccctttgggaggctgaggtgggcagactgctttgagctcaggagttggagaccagcctggggaacatggcaacaccacctccctacaaaagacacaaaaattagccagacgtagtggctcatgcctgtagttccagcggctcaggaggctgaggctggaggatcacttgagccttcaagagggaaacagaagtggcagtgagccaagatcacaccattgcacaccatcctgggtgacagaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaa

SEQ ID NO: 13582 - DNA, 746 bp, Artificial Sequence
  Synthetic polypeptide
gcagggtgcggtggctcacccctgtaattccagccctttgggaggctgaggtgggcagactgctttgagctcaggagttggagaccagcctggggaacatggcaacaccacctccctacaaaagacacaaaaattagccagacgtagtggctcatgcctgtagttccagcggctcaggaggctgaggctggaggatcacttgagccttcaagagggaaacagaagtggcagtgagccaagatcacaccattgcacaccatcctgggtgacagaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctga

SEQ ID NO: 13583 - DNA, 755 bp, Artificial Sequence
  Synthetic polypeptide
cctggttctctggggcacgaggcttctcctcagcactctggcgcccccaacaggttcccagtgttcggctgggacaggcacgctgtggctggctacttcccttccttccatcccccttgggccaaacaggatcggtgcttctggtgagacgtctccccatgcacatcactcccagatgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13584 - DNA, 1122 bp, Artificial Sequence
  Synthetic polypeptide
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtag

SEQ ID NO: 13585 - DNA, 501 bp, Artificial Sequence
  Synthetic polypeptide
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgctgaacatactgacttgtggagtcattggctcctattcggtggttttagccattga

SEQ ID NO: 13586 - DNA, 639 bp, Artificial Sequence
  Synthetic polypeptide
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactggagacaggatctctttctgtcacccatgctggactgcagtga

SEQ ID NO: 13587 - DNA, 342 bp, Artificial Sequence
  Synthetic polypeptide
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctagctgtgctgtacctgcttctctgcctctccacctcatcaccctcctttatcactggattattttaa

SEQ ID NO: 13588 - DNA, 445 bp, Artificial Sequence
  Synthetic polypeptide
ggccgggcgcggtggctcacgcctgtaatcccagcactttgggaggccgaggcgggtggatcatgaggtcaggagatcgagaccatcctggctaacaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatg

SEQ ID NO: 13589 - DNA, 755 bp, Artificial Sequence; identical to SEQ ID NO: 13583
  Synthetic polypeptide

SEQ ID NO: 13590 - DNA, 335 bp, Artificial Sequence
  Synthetic polypeptide
ctgtctgagccccggcgccggccctgcgctgctacgtctgtccggagcccacaggagtgtcggactgtgtcaccatcgccacctgcaccaccaacgaaaccatgtgcaagaccacactctactcccgggagatagtgtaccccttccagggggactccacggtgaccaagtcctgtgccagcaagtgtaagccctcggatgtggatggcatcggccagaccctgcccgtgtcctgctgcaatactgagctgtgcaatgtagacggggcgcccgctctgaacagcctccactgcggggccctcacgctcctcccactcttgagcctccgactgtag

SEQ ID NO: 13591 - DNA, 503 bp, Artificial Sequence; identical to SEQ ID NO: 493
  Synthetic polypeptide

SEQ ID NO: 13592 - DNA, 476 bp, Artificial Sequence; identical to SEQ ID NO: 495
  Synthetic polypeptide

SEQ ID NO: 13593 - DNA, 539 bp, Artificial Sequence; identical to SEQ ID NO: 496
  Synthetic polypeptide

SEQ ID NO: 13594 - DNA, 1624 bp, Artificial Sequence
  Synthetic polypeptide
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggaggtgaggagcgtctctgcccggccgccccgtctgagaagtgaggagaccctccgcccggcagccgccccgtctgagaagttaggagcctctccgcccggcagccgccccgtctgggaagtgaggagcgtctctgcccggcagccaccccgtccgggagggaggtggggggggtcagccccccgcccggccagccgccccgtccgggaggtgaggggaacctctgcccggccgcccctactgggaagtgaggagcccctctgcctagccagctgccccgtccgggagggaggtgggggggtcagccccccgcccggccagccgccccgtccgggagggaggtgggggggtcagccccccgcccggccagccgccccgtccgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13595 - DNA, 463 bp, Artificial Sequence; identical to SEQ ID NO: 7109
  Synthetic polypeptide

SEQ ID NO: 13596 - DNA, 663 bp, Artificial Sequence
  Synthetic polypeptide
gccaggtgcagtggctcactcctgtaatcctaacactttgggaggctgaggcaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataa

SEQ ID NO: 13597 - DNA, 236 bp, Artificial Sequence
  Synthetic polypeptide
gccaggtgcagtggctcactcctgtaatcctaacactttgggaggctgaggcaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaa

SEQ ID NO: 13598 - DNA, 683 bp, Artificial Sequence; identical to SEQ ID NO: 12254
  Synthetic polypeptide

SEQ ID NO: 13599 - DNA, 2094 bp, Artificial Sequence; identical to SEQ ID NO: 865
  Synthetic polypeptide

SEQ ID NO: 13600 - DNA, 2067 bp, Artificial Sequence; identical to SEQ ID NO: 868
  Synthetic polypeptide

SEQ ID NO: 13601 - DNA, 1234 bp, Artificial Sequence
  Synthetic polypeptide
ggggtggggtgggggtggggaggacacacacttgtagctagggcaggctctggtagcatctgtgtacccatcgtggcccctctgccctgttgttattccaccttggctccgggcccctgtgtgcctcagtgtctgcacctgtgatgaacctgccctgcaaggttgctgaggagattaagtaagctacctggtggcgcacaccctagggcgccggatgctgtatccaggctctgtgtacctgctgcagaaggccctcatgcctgtgctgctgcagggccaggcccgactggtggaagagtgtaatgggcgccgggcaaagctgctggcctgtgatggcaatgagattgacaccatgtttgtggaccggcgggggacagctgagccccagggacagaagctggtgatctgctgtgaggggaatgctgggttttatgaggtgggctgcgtctccacgcccctggaagctggatattcagtcctgggctggaatcatccaggctttgctggaagcacgggggtgccattcccgcagaatgaggctaatgccatggatgtggtggtccagtttgccatccaccgcctaggcttccagccccaggacatcatcatctacgcctggtccatcggcggcttcactgccacgtgggcagccatgtcctacccagatgttagtgccatgatcctggatgcctcctttgatgacctggtgcccttggccttgaaggtcatgccagacagctggaggggcctggtgaccaggaccgtgaggcagcatctcaatctaaacaacgcggagcagctgtgcagataccagggtcctgtactgctgatccggagaaccaaggatgagatcatcaccaccacggttcctgaggacatcatgtccaaccgaggcaatgacctcctgctgaagctcctgcagcatcggtatccccgggtgatggcagaggagggtcttcgagtggtgaggcagtggttggaggcctcctcacagctggaggaagcctcaatttatagccgatgggaggtggaagaggactggtgtctgtctgtcctccgctcctaccaggcagaacacgggcccgacttcccctggagcgtgggggaggacatgagtgcagatggacggcggcagctggctttgtttctggctcggaagcatctgcacaactttgaggccactcactgcaccccactcccagcccagaacttccagatgccctggcacctctag

SEQ ID NO: 13602 - DNA, 339 bp, Artificial Sequence
  Synthetic polypeptide
gttgcgccgccccggccaagcctcagcctttctgggccttagcttcttcacgtgtaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaa

SEQ ID NO: 13603 - DNA, 1554 bp, Artificial Sequence
  Synthetic polypeptide
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagccaccccgctgagcttgacctccctcgagccccccagccacccaatgctctaggctacactgtctccagcttttccaatggctgccctggagagggcccacgattctcagctccccggcggctctcgacaagcagcctgcggcacccctcgcttggggaagagtccacccatgccctcattgctcctgatgagcagtcccacacctatgtcaacacaccggccagtgaagatgaccaccgcaggggccgccactgcctgcagcccctgcctgagggtcaggcacccttcctcccgcaggcccggggacctgaccaacgggacccacaggtgttcttgcagccaggccaggtgaagtttgtgttgggcccgacccctgctcggcggcacatggtgaagtgccagggcctctgtcccagcctgcatgaccccccacaccacaataataacaatgaggccccttctgagtgtccagcccagcccaagtgcacctacgagaacgtcaccggggggctgtggcgaggggctggctggagactgagcccagaggagccgggctggaatggccttgcccaccgccgggccgccctgctgcactatgagaacctgcccccactgccccctgtgtgggaaagccaagcccagcagctgggaggggaggctggggatgatggggactcgagggatgggctcacaccctcttccaatggcttccctgatggtgaggaggacgagaccccactgcagaagcccaccagcacccgggccgccatccgcagccacggcagctttcctgtgccactgacccgccgccgcggctccccaagggtcttcaactttgatttccgccggccggggcccgagcccccaaggcagcttaactacatccaggtggagctaaagggctggggtggagaccgccctaaggggccccagaacccctcgagcccccaagcccccatgcccaccacccaccctgcccgaagctcagactcctacgccgtgattgacctcaaaaagaccgtggccatgtccaacctgcagagagctctgccccgagacgatggcaccgccaggaaaacccggcacaacagcaccgacctgcctctgtag

SEQ ID NO: 13604 - DNA, 444 bp, Artificial Sequence
  Synthetic polypeptide
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctggggtgatggagctgacgcagagtgagctggtgctgcacctgcatcggcgtgaggccgtccgctggccttatctctgcttgcggcgctatggctacgactccaacctcttctcctttgagagtggccgccgatgtcagacaggccagggaatatttgcatttaagtgttcccgggctgaggaaatcttcaacctccttcaggatctgatgcagtgcaacagcatcaatgtgatggaagagcctgtcatcatcacccgcaatagc

SEQ ID NO: 13605 - DNA, 184 bp, Artificial Sequence
  Synthetic polypeptide
ggccaggcacggtggctcacacctgtaataccagcacttttggaggccaaggcaggcggatcacctgaggtcaggagctcgagaccagcctggccaacatggcgaaaccccgtctctactaaaaatacaaaaattagccaggtgacaaatgtggatgatgagggggtggagctgggctctgggg

SEQ ID NO: 13606 - DNA, 981 bp, Artificial Sequence; identical to SEQ ID NO: 12548
  Synthetic polypeptide

SEQ ID NO: 13607 - DNA, 628 bp, Artificial Sequence
  Synthetic polypeptide
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaacatcctagatgagatcaaaaagcccaagaatgtgactctcatcttggttggaaacaaagctgacttggaccactccaggcaggttagcacagaagaaggagagaagctggccacagaattggcttgtgctttttacgagtgctctgcctgcactggagaagggaacatcacagagatattctatgaattgtgtcgagaggtgcgtcgccggaggatggtgcagggcaagacgaggcgacgcagctccaccacgcatgtcaagcaagccattaacaagatgctcaccaaaatcagtagttag

SEQ ID NO: 13608 - DNA, 329 bp, Artificial Sequence
  Synthetic polypeptide
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggaagataccattcagagggaggggcacatgcgatggggggaaggctttgtgctggtctacgacattactgaccgaggaagttttgaggaagtgctgccacttaagaaca

SEQ ID NO: 13609 - DNA, 241 bp, Artificial Sequence
  Synthetic polypeptide
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccctcgaatcaacctaccgacaccaagcaaccatcgatgatgaagttgtttccatggagatactagacactgctggtcaggtgaataaagagttcagctaa

SEQ ID NO: 13610 - DNA, 144 bp, Artificial Sequence
  Synthetic polypeptide
ggtaaccatccatcacggttttcccagaacaggctgatttgcgtcttctgtcctggcataaggatcccttcactctcggaagtgttccgctcttgtagtgagatttctgaccaaacggttcatctgggaatatgatcccaccct

SEQ ID NO: 13611 - DNA, 755 bp, Artificial Sequence
  Synthetic polypeptide
cctggttctctggggcacgaggcttctcctcagcactctggcgcccccaacaggttcccagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacaagaaattaatgctgatataaaacgtaaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 13612 - DNA, 2158 bp, Artificial Sequence; identical to SEQ ID NO: 514
  Synthetic polypeptide

SEQ ID NO: 13613 - DNA, 124 bp, Artificial Sequence; identical to SEQ ID NO: 515
  Synthetic polypeptide

SEQ ID NO: 13614 - DNA, 166 bp, Artificial Sequence; identical to SEQ ID NO: 516
  Synthetic polypeptide

SEQ ID NO: 13615 - DNA, 1776 bp, Artificial Sequence; identical to SEQ ID NO: 517
  Synthetic polypeptide

SEQ ID NO: 13616 - DNA, 319 bp, Artificial Sequence; identical to SEQ ID NO: 520
  Synthetic polypeptide

SEQ ID NO: 13617 - DNA, 755 bp, Artificial Sequence; identical to SEQ ID NO: 13611
  Synthetic polypeptide

SEQ ID NO: 13618 - DNA, 225 bp, Artificial Sequence; identical to SEQ ID NO: 7100
  Synthetic polypeptide

SEQ ID NO: 13619 - DNA, 481 bp, Artificial Sequence
  Synthetic polypeptide
ggctaaaggagatgcagcaggagatcagagggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataa

SEQ ID NO: 13620 - DNA, 2528 bp, Artificial Sequence
  Synthetic polypeptide
ggctaaaggagatgcagcaggagatcagagggaaaaactgcatagaaaatctaatggatgaagatgagaaagacagagccaagagagcttctcgaaacaagtctgagaagaagcgtcgggaccagttcaatgttctcatcaaagagctcagttccatgctccctggcaacacgcggaaaatggacaaaaccaccgtgttggaaaaggtcatcggatttttgcagaaacacaatgaagtctcagcgcaaacggaaatctgtgacattcagcaagactggaagccttcattcctcagtaatgaagaattcacccagctgatgttggaggcattagatggcttcattatcgcagtgacaacagacggcagcatcatctatgtctctgacagtatcacgcctctccttgggcatttaccgtcggatgtcatggatcagaatttgttaaatttcctcccagaacaagaacattcagaagtttataaaatcctttcttcccatatgcttgtgacggattccccctccccagaatacttaaaatctgacagcgatttagagttttattgccatcttctcagaggcagcttgaacccaaaggaatttccaacttatgaatacataaaatttgtaggaaattttcgctcttacaacaatgtgcctagcccctcctgtaatggttttgacaacaccctttcaagaccttgccgggtgccactaggaaaggaggtttgcttcattgccaccgttcgtctggcaacaccacaattcttaaaggaaatgtgcatagttgacgaacctttagaggaattcacttcaaggcatagcttggaatggaaatttttatttctggatcacagagcacctccaatcataggatacctgccttttgaagtgctgggaacctcaggctatgactactaccacattgatgacctggagctcctggccaggtgtcaccagcacctgatgcagtttggcaaagggaagtcgtgttgctaccggtttctgaccaaaggtcagcagtggatctggctgcagactcactactacatcacctaccatcagtggaactccaagcccgagttcatcgtgtgcacacactcggtggtcagttacgcagatgtccgggtggaaaggaggcaggagctggctctggaagacccgccatccgaggccctccactcctcagcactaaaggacaagggctcaagcctggaacctcggcagcactttaacacactcgacgtgggtgcctcgggccttaataccagtcattcgccatcggcgtcctcaagaagttcccacaaatcctcgcacacagccatgtcagaacccacctccactcccaccaagctgatggcagaggccagcaccccggctttgccaagatcagccaccctgccccaagagttacctgtccccgggctcagccaggcagccaccatgccggcccctctgccttccccatcgtcctgcgacctcacacagcagctcctgcctcagaccgttctgcagagcacgcccgctcccatggcacagttttcggcacagttcagcatgttccagaccatcaaagaccagctagagcagcggacgcggatcctgcaggccaatatccggtggcaacaggaagagctccacaagatccaggagcagctctgcctggtccaggactccaacgtccagatgttcctgcagcagccagctgtatccctgagcttcagcagcacccagcgacctgaggctcagcagcagctacagcaaaggtcagctgcagtgactcagccccagctcggggcgggcccccaacttccagggcagatctcctctgcccaggtcacaagccagcacctgctcagagaatcaagtgtgatatcaacccagggtccaaagccaatgagaagctcacagctaatgcagagcagcggccgctctggaagcagcctagtgtccccgttcagcagcgccacagctgcgctcccgccaagtctgaatctgaccacacctgcttccacctcccaggatgccagccagtgccagcccagcccagacttcagccatgatcggcagctcaggctgttgctgagccagcccatccagcccatgatgcccgggtcctgtgacgcaaggcagccctcggaagtcagcaggacgggacggcaagtcaagtacgcccagagccagaccgtgtttcaaaatccagacgcacaccccgccaacagcagcagcgccccgatgcccgtcctgctgatggggcaggcggtgctccaccccagcttccctgcctcccaaccatcgcccctgcagcctgcacaggcccggcagcagccaccgcagcactacctgcaggtacaggcaccaacctctttgcacagtgagcagcaggactcgctacttctctccacctactcacaacagccagggaccctgggctacccccaaccacccccagcacagccccagcccctacgtcctccccgaagggtcagcagtctgtctgagtcgtcaggcctccagcagccgccccgataa

SEQ ID NO: 13621 - DNA, 198 bp, Artificial Sequence; identical to SEQ ID NO: 8406
  Synthetic polypeptide

SEQ ID NO: 13622 - DNA, 214 bp, Artificial Sequence
  Synthetic polypeptide
ggctgggcccagtagctcgtgcctgtaatcccagcattttgaatacgctgccatcaactccatgctggaccagatcaactcctgtctggaccacctggaggagaagaatgaccacctccacgcccgcctccaggagctgctggagtccaaccggcagacacgcctggagttccagcagcagctcggggaggcccccagtgatgccagcccctag

SEQ ID NO: 13623 - DNA, 462 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataa

SEQ ID NO: 13624 - DNA, 166 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctg

SEQ ID NO: 13625 - DNA, 255 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaa

SEQ ID NO: 13626 - DNA, 275 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaaga

SEQ ID NO: 13627 - DNA, 139 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggaga

SEQ ID NO: 13628 - DNA, 292 bp, Artificial Sequence
  Synthetic polypeptide
ggccaggtgtggtggctcatgcctataatcccagcactctgggaggccgaggtaggtggatcaggaggtcaggaattcgagaccagcctggccactacggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgt

SEQ ID NO: 13629 - DNA, 284 bp, Artificial Sequence
  Synthetic polypeptide
tcctgttcatcctttgagcttctgcttaaacatcacttctgagagtccttctctgatttctcatctagtattctgaaaaggaggacaaatatgaagaagaaattaaacttctgtctgacaaactgaaagaggctgagacccgtgctgaatttgcagagagaacggttgcaaaactggaaaagacaattgatgacctggaagagaaacttgcccaggccaaagaagagaacgtgggcttacatcagacactggatcagacactaaacgaacttaactgtatataa

SEQ ID NO: 13630 - DNA, 77 bp, Artificial Sequence
  Synthetic polypeptide
tcctgttcatcctttgagcttctgcttaaacatcacttctgagagtccttctctgatttctcatctagtattctgaa

SEQ ID NO: 13631 - DNA, 97 bp, Artificial Sequence
  Synthetic polypeptide
tcctgttcatcctttgagcttctgcttaaacatcacttctgagagtccttctctgatttctcatctagtattctgaaaaggaggacaaatatgaaga

SEQ ID NO: 13632 - DNA, 114 bp, Artificial Sequence
  Synthetic polypeptide
tcctgttcatcctttgagcttctgcttaaacatcacttctgagagtccttctctgatttctcatctagtattctgaaaaggaggacaaatatgaagaagaaattaaacttctgt

SEQ ID NO: 13633 - DNA, 4686 bp, Artificial Sequence; identical to SEQ ID NO: 8201
  Synthetic polypeptide

SEQ ID NO: 13634 - DNA, 6266 bp, Artificial Sequence; identical to SEQ ID NO: 8202
  Synthetic polypeptide

SEQ ID NO: 13635 - DNA, 5837 bp, Artificial Sequence; identical to SEQ ID NO: 8203
  Synthetic polypeptide

SEQ ID NO: 13636 - DNA, 367 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 13637 - DNA, 358 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 13638 - DNA, 456 bp, Artificial Sequence
  Synthetic polypeptide
ggccaggtgccgtggctcacacttgtaatcccagcactttgggaggccaaggctgatgaattcatccgagcaaatgccaccaacaagctgacagtcatagctgagcaaatccaacatttgcaagaacaagccaggaaggtactggaagatgctcacagagatgccaacctgcaccatgtagcttgtaatatagtgaaaaaacctggcaacatttactatctctataaacgggagagtggtcagcagtatttttccatcatttctccaaaggaatgggggacaagttgtccacatgacttccttggtgcctacaaactacagcatgacttgtcctggactccgtatgaggacattgagaagcaagatgctaaaatcagcatgatggacacgttgctaagccagtcagtggccctgcctccgtgcactgaacccaacttccagggactgactcactga

SEQ ID NO: 13639 - DNA, 2417 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaagttaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaa

SEQ ID NO: 13640 - DNA, 1019 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataag

SEQ ID NO: 13641 - DNA, 1032 bp, Artificial Sequence
  Synthetic polypeptide
tacatccctttcttcccttccaaatcgagcaaggatgcctgccctggaagtgtataaacccggggaagggagacagaaaaggatagttttaagtattggtgttggggacgtgttctttagccaaggcagcatgaacccatggcagcacttcccaaccttcctgacatgggcgtttctgtgaactccagtgtgatggagaaatggcattggctcaggtgtgcagctagatatgttacagagcagggtgacaggcaggggtgatgagttttgttttaacaacctgtcccttcaaccctcatggtactgacaaagatcacatggctctcgggggagattcctgcgaggggaagcaaggagagcatccttacatattattgatccaggcagcagatttgcagcaaagctctgtgctttattcatctgttaaaatagttaaaatagtcaaaacataggaaaaggattctgggaagtcagaatcggcttcagagcacacccctcctgcacttgcccggttctcagacttgggaatgggactgggtgggtgggtactctcgggtgttccgcgggtttgggtcttacttgtacactttgcttgatttcaaggaggtgcaggagaacagctctgtgataccatttaacttgttgacattacttttatttgaaggaacgtatattagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactca

SEQ ID NO: 13642 - DNA, 905 bp, Artificial Sequence
  Synthetic polypeptide
agcaatgaaaagacgcctggttgggagttcagacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatga

SEQ ID NO: 13643 - DNA, 812 bp, Artificial Sequence
  Synthetic polypeptide
agcaatgaaaagacgcctggttgggagttcagacctatgccagatttactggtgctccactgaaggtacacaagatcagcaacccctggcagagcccttcaggaactctgcctgcccttcggaccagtcatggagaggtcatctcagttccacacaagatcatcacccaccttcgaaaagaggtacatactttttggatagacaccaagaactacgtggaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggagctgtaccgagaggctcgggagtgtctgaccctgctctctcagcgcctgggctctcaaaagttcttctttggagatgcccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatga

SEQ ID NO: 13644 - DNA, 314 bp, Artificial Sequence
  Synthetic polypeptide
agcaatgaaaagacgcctggttgggagttcagacctatgccagatttactggtgctccactgaaggtacacaagatcagcaacccctggcagagcccttcaggtacccagtatcccttgggggaactctgcctgcccttcggaccagtcatggagaggtcatctcagttccacacaagatcatcacccaccttcgaaaagagaagtacaatgctgattatgatctgtcagctcggcaaggggcagacaccctggccttcatgtctctcctggaggagaagttgctcccggtgctggtacatactttttggatag

SEQ ID NO: 13645 - DNA, 224 bp, Artificial Sequence; identical to SEQ ID NO: 12336
  Synthetic polypeptide

SEQ ID NO: 13646 - DNA, 831 bp, Artificial Sequence
  Synthetic polypeptide
acctctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtga

SEQ ID NO: 13647 - DNA, 239 bp, Artificial Sequence
  Synthetic polypeptide
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaa

SEQ ID NO: 13648 - DNA, 379 bp, Artificial Sequence
  Synthetic polypeptide
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctga

SEQ ID NO: 13649 - DNA, 761 bp, Artificial Sequence
  Synthetic polypeptide
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagcatcccgccgctgttgtccgctggggattttgtgcttctggggtcctga

SEQ ID NO: 13650 - DNA, 863 bp, Artificial Sequence
  Synthetic polypeptide
ggccgggtgcggtagctcaggcctgtaatcccagcgtttgggaggctgaggccggaggatcgcttgagaaatttgaaaccagcctgggcaacatagtgagacccccatctctacaaaaaatacaaaaaaaattggccgagcgaggtggcgcgcgcctgtggtcccagctactcgggaggctgaggcgagaaccactgtctctgatcaacgtgcggaagaggaacgtggaatctggggaagaagagctggcgtccaagctggaccactacaaagccaaggccacgcggcacatcttcctcatcaggcattcccagtaccacgtggatggctccctggagaaggaccgcactctgaccccgctgggtcgggagcaggctgaactcactgggctccgcctggcaagcttggggttgaagtttaataaaatcgtccattcgtctatgacgcgcgccatagagaccaccgatatcatcagccggcacctgccaggcgtctgcaaagtcagcacagatctgctgcgggaaggcgcccccatcgagccagacccgcccgtgtctcattggaagccggaagctgtgcagtattacgaagacggagcccggatcgaggccgccttccggaactacatccaccgcgcagatgccaggcaggaggaggacagttacgagatcttcatctgtcacgccaacgtcatccgctacatcgtgtgcagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctga

SEQ ID NO: 13651 - DNA, 806 bp, Artificial Sequence; identical to SEQ ID NO: 6950
  Synthetic polypeptide

SEQ ID NO: 13652 - DNA, 331 bp, Artificial Sequence; identical to SEQ ID NO: 8434
  Synthetic polypeptide

SEQ ID NO: 13653 - DNA, 1538 bp, Artificial Sequence; identical to SEQ ID NO: 8435
  Synthetic polypeptide

SEQ ID NO: 13654 - DNA, 884 bp, Artificial Sequence; identical to SEQ ID NO: 8436
  Synthetic polypeptide

SEQ ID NO: 13655 - DNA, 343 bp, Artificial Sequence; identical to SEQ ID NO: 8437
  Synthetic polypeptide

SEQ ID NO: 13656 - DNA, 401 bp, Artificial Sequence; identical to SEQ ID NO: 8438
  Synthetic polypeptide

SEQ ID NO: 13657 - DNA, 1535 bp, Artificial Sequence; identical to SEQ ID NO: 8439
  Synthetic polypeptide

SEQ ID NO: 13658 - DNA, 255 bp, Artificial Sequence; identical to SEQ ID NO: 8440
  Synthetic polypeptide

SEQ ID NO: 13659 - DNA, 88 bp, Artificial Sequence; identical to SEQ ID NO: 8441
  Synthetic polypeptide

SEQ ID NO: 13660 - DNA, 429 bp, Artificial Sequence; identical to SEQ ID NO: 8442
  Synthetic polypeptide

SEQ ID NO: 13661 - DNA, 928 bp, Artificial Sequence; identical to SEQ ID NO: 11299
  Synthetic polypeptide

SEQ ID NO: 13662 - DNA, 1942 bp, Artificial Sequence; identical to SEQ ID NO: 11300
  Synthetic polypeptide

SEQ ID NO: 13663 - DNA, 1660 bp, Artificial Sequence; identical to SEQ ID NO: 11301
  Synthetic polypeptide

SEQ ID NO: 13664 - DNA, 175 bp, Artificial Sequence; identical to SEQ ID NO: 11302
  Synthetic polypeptide

SEQ ID NO: 13665 - DNA, 547 bp, Artificial Sequence; identical to SEQ ID NO: 11303
  Synthetic polypeptide

SEQ ID NO: 13666 - DNA, 481 bp, Artificial Sequence; identical to SEQ ID NO: 11304
  Synthetic polypeptide

SEQ ID NO: 13667 - DNA, 620 bp, Artificial Sequence; identical to SEQ ID NO: 11305
  Synthetic polypeptide

SEQ ID NO: 13668 - DNA, 819 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 13669 - DNA, 885 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 13670 - DNA, 954 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 13671 - DNA, 813 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 13672 - DNA, 2174 bp, Artificial Sequence
  Synthetic polypeptide
ggcggcggcggcggcgggcgcagagcgcggcatgggcgcccgggccgcggggcctggcggcggcgggcggacgggcgcgcggctgcgggcgcagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctga

SEQ ID NO: 13673 - DNA, 899 bp, Artificial Sequence
  Synthetic polypeptide
ggcggcggcggcggcgggcgcagagcgcggcatgggcgcccgggccgcggggcctggcggcggcgggcggacgggcgcgcggctgcgggcgcagaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtggtgtgcacgctggtggccgccttcctgcacttcttcttcctgtcctccttctgctgggtgctcaccgaggcctggcagtcctacatggcggtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctgggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtag

SEQ ID NO: 13674 - DNA, 2256 bp, Artificial Sequence; identical to SEQ ID NO: 8407
  Synthetic polypeptide

SEQ ID NO: 13675 - DNA, 552 bp, Artificial Sequence
  Synthetic polypeptide
ggccaggcgcggtggctcacgcctgtaatcccagcacttagggaggctgaggcaggcggatcacgaggtcaggagatcaagaccatcctggctaacacgatgaatggctatcaaagaaggatcaaaaatgcaactgagaaaatgatggctcttgttgctgagctgtccatgaaacaagccctaaccattgaactccaaaaggaagtcagggagaaagaagacttcatcttcacttgcaattccaggatagaaaaaggtctgccactcaataaggaaattgagaaagaatggttgaaagtccttcgagatgaagaaatgcacgccttggccatcgctgaaaagtctcaggagttcttggaagcagataatcgccagctgcccaatggtgtttacacaactgcagagcagcgtccgaatgcctacatcccagaagcagatgccactcttcctttgccaaaaccttatggtgctttggctccttttaaacccagtgaacctggagccaatatgaggcacataaggaaacctgttataaagccagttgaaatctga

SEQ ID NO: 13676 - DNA, 2624 bp, Artificial Sequence; identical to SEQ ID NO: 8408
  Synthetic polypeptide

SEQ ID NO: 13677 - DNA, 2678 bp, Artificial Sequence; identical to SEQ ID NO: 8409
  Synthetic polypeptide

SEQ ID NO: 13678 - DNA, 2717 bp, Artificial Sequence; identical to SEQ ID NO: 8410
  Synthetic polypeptide

SEQ ID NO: 13679 - DNA, 2624 bp, Artificial Sequence; identical to SEQ ID NO: 8411
  Synthetic polypeptide

SEQ ID NO: 13680 - DNA, 2783 bp, Artificial Sequence; identical to SEQ ID NO: 8412
  Synthetic polypeptide

SEQ ID NO: 13681 - DNA, 2696 bp, Artificial Sequence; identical to SEQ ID NO: 8413
  Synthetic polypeptide

SEQ ID NO: 13682 - DNA, 2678 bp, Artificial Sequence; identical to SEQ ID NO: 8414
  Synthetic polypeptide

SEQ ID NO: 13683 - DNA, 677 bp, Artificial Sequence; identical to SEQ ID NO: 8415
  Synthetic polypeptide

SEQ ID NO: 13684 - DNA, 122 bp, Artificial Sequence
  Synthetic polypeptide
ggccaggtgttgtgactcacacttgtaatctcagcactttgagaggtcaaggcaggaggattgctcgaggcctggagtttgagaccagactggtcaggatgtgtttgaaagatgtatggtga

SEQ ID NO: 13685 - DNA, 108 bp, Artificial Sequence
  Synthetic polypeptide
ggccaggtgttgtgactcacacttgtaatctcagcactttgagaggtcaaggcaggaggattgctcgaggcctggagtttgagaccagactggtcaggatgtgtttga

SEQ ID NO: 13686 - DNA, 3042 bp, Artificial Sequence; identical to SEQ ID NO: 8824
  Synthetic polypeptide

SEQ ID NO: 13687 - DNA, 209 bp, Artificial Sequence
  Synthetic polypeptide
gtggtcgggagagtgcacgccggtgccgcctgggctccagactgggcgcgaccactaacccggttaatgacctcgggcttaacttaaccccttcgctgctctgggcctgcgtttctccaccggtgaaatgaggtggtacagaagttggtcctgccctttgggcgactgaactacctgcccctggaacagcagtttatgccctgccttga

SEQ ID NO: 13688 - DNA, 957 bp, Artificial Sequence
  Synthetic polypeptide
gtggtcgggagagtgcacgccggtgccgcctgggctccagactgggcgcgaccactaacccggttaatgacctcgggcttaacttaaccccttcgctgctctgggcctgcgtttctccaccggtgaaatgaggtggtacagaagttggtcctgccctttgggcgactgaactacctgcccctggaacagcagtttatgccctgccttgagaggatcctggctcgggaagcaggggtggcacccctggctacagtcaacatcttgatgtcactgtgccaactgcggtgcctgcccttcagagccctgcactttgttttttcccctggcttcatcaactacatcagtggcacccctcatgctctgattgtgcgtcgctacctctccctgctggacacggccgtggagctggagctcccaggataccggggtccccgccttccccgaaggcagcaagtgcccatctttccccagcctctcatcaccgaccgtgcccgctgcaagtacagtcacaaggacatagtagctgaggggttgcgccagctgctgggggaggagaaataccgccaggacctgactgtgcctccaggctactgcacagacttcctgctgtgcgccagcagctctggtgctgtgcttcccgtgaggacccaggaccccttcctgccatacccaccaaggtcctgcccacagggccaggctgcctctagcgccactactcgagaccctgcccagagggtggtgctggtgttgcgggaacgctggcatttctgccgggacggccgggtgctgctgggctcgagggccctgagggagcggcacctaggcctgatgggctaccagctcctgccgctacccttcgaggaactggagtcccagagaggcctgccccagctcaagagctacctgaggcagaagctccaggccctgggcctgcgctgggggcctgaagggggctga

SEQ ID NO: 13689 - DNA, 294 bp, Artificial Sequence
  Synthetic polypeptide
gaggcagtggaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaa

SEQ ID NO: 13690 - DNA, 104 bp, Artificial Sequence
  Synthetic polypeptide
gaggcagtggaccaccccgtggagctgctggcccgggacttcgagaagaactataacatgtacatcttccctgtacactggcagttcggccagctggaccagca

SEQ ID NO: 13691 - DNA, 460 bp, Artificial Sequence; identical to SEQ ID NO: 813
  Synthetic polypeptide

SEQ ID NO: 13692 - DNA, 619 bp, Artificial Sequence
  Synthetic polypeptide
ccatacttcgaattaggaatctttatcttttcccaagctagcaatgtgtggtacaatactctgttgcaatactcagcaggaacccacagctcccagtcacctgcccaatcacaggggtaaacaaccagtactctacggtgtactgtgttgctaggtgatttcacctaactgtaagctaatgtaagctagtgtaagctttttgagcacattgaaggccagactatggtgtttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtga

SEQ ID NO: 13693 - DNA, 352 bp, Artificial Sequence
  Synthetic polypeptide
gcagtggcttgcgcctataatcccagcactttgggaggccgaggcatgtggatcacttgaagtcaggagttttaagaccagcctgggcaacgtggcgaaatcctgtctactaaaaatacaaaaattagccagattataccgaaaagaagttctagagaaattaatagaaaaatgtgtttctaaaggctacgtcttccagatggagatgattgttcgggcaagacagttgaattatactattggcgaggttccaatatcatttgtggatcgtgtttatggtgaatccaagttgggaggaaatgaaatagtatctttcttgaaaggattattgactctttttgctactacataa

SEQ ID NO: 13694 - DNA, 247 bp, Artificial Sequence
  Synthetic polypeptide
gcagtggcttgcgcctataatcccagcactttgggaggccgaggcatgtggatcacttgaagtcaggagttttaagaccagcctgggcaacgtggcgaaatcctgtctactaaaaatacaaaaattagccagattataccgaaaagaagttctagagaaattaatagaaaaatgtgtttctaaaggctacgtcttccagatggagatgattgttcgggcaagacagttgaattatactattggcgag

SEQ ID NO: 13695 - DNA, 168 bp, Artificial Sequence
  Synthetic polypeptide
ggccaggcacagttgctcacgcctctaattccagcactttggggggctgaggaggcagcgacccggaaacagcgtatcactgagaccgagtcgccttatcaggagctccagggtcagaggtcggatgtctacagcgacctcaacacacagaggccgtattacaaatga

SEQ ID NO: 13696 - DNA, 292 bp, Artificial Sequence
  Synthetic polypeptide
ggccaggagtggtggctcacgcctgtaatcccagcactttgggaggccaagaactcagcctcctcccaagctccctgtgggtcctagccacaagctctccaacaattactattgcactcgcgatggccgccgggaatctgtgcccccttccatcatcatgtcgtcgcagaaggcgctggtgtcaggcaagccagcagagagctctgctgtagctgccactgagaagaaggcggtgactccagctcctcccataaagaggtgggagctgtcctcggaccagccttacctgtga

SEQ ID NO: 13697 - DNA, 87 bp, Artificial Sequence
  Synthetic polypeptide
ggccaggagtggtggctcacgcctgtaatcccagcactttgggaggccaagaactcagcctcctcccaagctccctgtgggtcctag

SEQ ID NO: 13698 - DNA, 2287 bp, Artificial Sequence; identical to SEQ ID NO: 6799
  Synthetic polypeptide

SEQ ID NO: 13699 - DNA, 2234 bp, Artificial Sequence; identical to SEQ ID NO: 6800
  Synthetic polypeptide

SEQ ID NO: 13700 - DNA, 1597 bp, Artificial Sequence
  Synthetic polypeptide
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtga

SEQ ID NO: 13701 - DNA, 893 bp, Artificial Sequence
  Synthetic polypeptide
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggaca

SEQ ID NO: 13702 - DNA, 451 bp, Artificial Sequence
  Synthetic polypeptide
gaccgggcgcagtggctcacgcctgtaatctcagcactttgggaggcctaggtgggcggatcacgaggtcaggagatcgagaccatcctagccaacatggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagttt

SEQ ID NO: 13703 - DNA, 3717 bp, Artificial Sequence; identical to SEQ ID NO: 7131
  Synthetic polypeptide

SEQ ID NO: 13704 - DNA, 3636 bp, Artificial Sequence; identical to SEQ ID NO: 7132
  Synthetic polypeptide

SEQ ID NO: 13705 - DNA, 3649 bp, Artificial Sequence; identical to SEQ ID NO: 10098
  Synthetic polypeptide

SEQ ID NO: 13706 - DNA, 3478 bp, Artificial Sequence; identical to SEQ ID NO: 10099
  Synthetic polypeptide

SEQ ID NO: 13707 - DNA, 3472 bp, Artificial Sequence; identical to SEQ ID NO: 10100
  Synthetic polypeptide

SEQ ID NO: 13708 - DNA, 3457 bp, Artificial Sequence; identical to SEQ ID NO: 10101
  Synthetic polypeptide

SEQ ID NO: 13709 - DNA, 472 bp, Artificial Sequence
  Synthetic polypeptide
tgctgtggtttgaatgtgttccccaaagttcatgtgttggaaactttatctccaaagcaatagtaattaacaggtgattaggccatgagggctctgctgtaatgaatggattcgtgctgttatcacaggagcgggttccttatagaaggatgaatttgtccccccaccttttatttctctccctctctttgctcttccaccaggagatgatgcagcaagaaggccttctccagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatga

SEQ ID NO: 13710 - DNA, 468 bp, Artificial Sequence
  Synthetic polypeptide
ggcgcggtggctcacgcctgtaatcccagcactttgggaggccaaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaagactccagctctgattgtatatggagaccaggaccccatgggtcagaccagctttgagcacctgaagcagctgcccaaccaccgggtgctgatcatgaagggggcggggcacccctgttacctggacaaaccagaggagtggcatacagggctgctggacttcctgcaggggctccagtga

SEQ ID NO: 13711 - DNA, 402 bp, Artificial Sequence
  Synthetic polypeptide
ggcgcggtggctcacgcctgtaatcccagcactttgggaggccaaggtctggggcactccaaggaagcagcagcccctgcccctattggggagctggcccctggcagcttcctggcggctgtggtggatgccttggagctgggccccccggttgtgatcagtccatcactgagtggcatgtactccctgcccttcctcacggcccctggctcccagctcccgggctttgtgccagtggcccccatctgcactgacaaaatcaatgctgccaactatgccagtgtgaaggtacccttgtgtgggaagctgaggtgcccctgccaggagcaaggaagggtgcatccctgggctttcctcatctgggggctggataatcaaggggtgtcttctgggaggagctga

SEQ ID NO: 13712 - DNA, 736 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcctgctctacaagtcaggagtgtaccaacacgtcaccggagagatgatgggtggccatgccatccgcatcctgggctggggagtggagaatggcacaccctactggctggttgccaactcctggaacactgactggggtgacaatggcttctttaaaatactcagaggacaggatcactgtggaatcgaatcagaagtggtggctggaattccacgcaccgatcagtactgggaaaagatctaa

SEQ ID NO: 13713 - DNA, 241 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggtggcctctatgaatcc

SEQ ID NO: 13714 - DNA, 226 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaaggcctggtttctggt

SEQ ID NO: 13715 - DNA, 211 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacggctgtaatggtggctatcctgctgaagcttggaacttctggacaagaaaa

SEQ ID NO: 13716 - DNA, 162 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcagcatgtgtggggacgg

SEQ ID NO: 13717 - DNA, 147 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggcag

SEQ ID NO: 13718 - DNA, 146 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggaggacctgctcacatgctgtggca

SEQ ID NO: 13719 - DNA, 124 bp, Artificial Sequence
  Synthetic polypeptide
gtggctcatcacgcctctaatcccagcactttgggaggccaaggccttcggggctgtggaagccatctctgaccggatctgcatccacaccaatgcgcacgtcagcgtggaggtgtcggcggag

SEQ ID NO: 13720 - DNA, 127 bp, Artificial Sequence; identical to SEQ ID NO: 8697
  Synthetic polypeptide

SEQ ID NO: 13721 - DNA, 425 bp, Artificial Sequence
  Synthetic polypeptide
ctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtga

SEQ ID NO: 13722 - DNA, 335 bp, Artificial Sequence
  Synthetic polypeptide
ctgggcgcggcaactcacacctgtaatctcagtactttgggaggccgaggcaggcagatcacctgaggtcaggaattcaagaccatcctggccagcatggcaaaaccccatctctactaaaaatacaaaaattagatgtggtggtgcgcacctgtaatcctatagtcccagctactcgagaggctgaggagctcgaggccatgagcagatataccagcccagtgaacccagctgtcttcccccatctgaccgtggtgcttttggccattggcatgttcttcaccgcctggttcttcgtgtatcctttcactgagcagccagaggaccagcattag

SEQ ID NO: 13723 - DNA, 524 bp, Artificial Sequence; identical to SEQ ID NO: 7813
  Synthetic polypeptide

SEQ ID NO: 13724 - DNA, 502 bp, Artificial Sequence; identical to SEQ ID NO: 7814
  Synthetic polypeptide

SEQ ID NO: 13725 - DNA, 295 bp, Artificial Sequence; identical to SEQ ID NO: 7815
  Synthetic polypeptide

SEQ ID NO: 13726 - DNA, 2502 bp, Artificial Sequence; identical to SEQ ID NO: 8603
  Synthetic polypeptide

SEQ ID NO: 13727 - DNA, 441 bp, Artificial Sequence; identical to SEQ ID NO: 8604
  Synthetic polypeptide

SEQ ID NO: 13728 - DNA, 2454 bp, Artificial Sequence; identical to SEQ ID NO: 8605
  Synthetic polypeptide

SEQ ID NO: 13729 - DNA, 242 bp, Artificial Sequence
  Synthetic polypeptide
tgaagaaaacatgtcccaccatcagctctgtttcgagatgggcagggctgtctcaggaggtctacatgttcaagtgcgtgtggcggtgctacagattgatcaagtgcatgaactcggtggaggagaagagaaactccaagatgctccagaaggtggtcctgccgtcctacgaggaagccctgtctttgccatcgaagaccccagaggggggcccagcaccacccccatactcagaggtgtga

SEQ ID NO: 13730 - DNA, 117 bp, Artificial Sequence
  Synthetic polypeptide
ggccaggcatggtggcacacacctgtaatcccagcactttgggaggccaaggagctccagggtcagaggtcggatgtctacagcgacctcaacacacagaggccgtattacaaatga

SEQ ID NO: 13731 - DNA, 675 bp, Artificial Sequence
  Synthetic polypeptide
ccatcttactggtttctgcctaagtatttaaacatgctcagttctcccatgttgaaattcccttctctttgacctcatccactactgccctatctggccattctttcccagccacacttattgcctatgctgtctctccttcactgccttaccctccccttacttcccaatatacagtattgtaatcgagcttctctccctgactaccctggaacttttcttgctaatgtcactggcaaccttcttatagctcagtctaagttgctgtctctgctggccttcatctgtgaagaagttgtatcacaatgtactttatgtggaggactttatttttttgagtttgtaagctgcagtgcctttcttctgagtctccttatactgattgtgtattgcactccattttatgagagagttgataccacaaaagtaaaatcatcggatttttatattactttgggaacaggatgtgtgtttttgttggcatccatcatttttgtttccacacatgacaggacttcagctgagattgctgcaattgtgtttggatttatagcaagttttatgttcctacttgactttatcactatgctgtatgaaaaacgacaggagtcccagctgagaaaacctgaaaataccactagggctgaagccctcactgagccacttaatgcctaa

SEQ ID NO: 13732 - DNA, 463 bp, Artificial Sequence; identical to SEQ ID NO: 803
  Synthetic polypeptide

SEQ ID NO: 13733 - DNA, 1241 bp, Artificial Sequence
  Synthetic polypeptide
tctgcctctccctctccctctccctctccccatggtctccctctccctctctttccaccgtctccctctcacgccaagccaaagctggactatactgctgccatctcggctcactgcaacctccctgcctgattctcctgcctcagcctgcggagtgcctgcaattgcaggcgcgcgccgccacgcctgactggttttcctatttttttggtggagacggggtttcgctgtgttggccgggctggtctccagctcctaaccgtgagtcatccgccagcctcggcctcccgaggtgccgggattgcagacggagtctggttcactcagtgctcagtggcgcccaggctggagtgcagtggcgtgatctcggctggctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccggccgccatcccatctgggaagtgaggagcgcctcttccaggccgccatcccatctaggaagtgaggagcgtctctgcccggccgcccatcgtctgagatgtggggagcgcctttgccccgccgccccgtctgggatgtgaggagcgcctctgcccagccgcgaccccgtctgggagagtcatggaggtctggcatggcttagtgatcgcggtggtgtccctcttcctgcaggcctgcttcctcaccgccatcaactacctgctcagcaggcacatggcccacaagagtgaacagatactgaaagcggccagtctccaggttcccaggcccagccctggccaccatcatccacctgctgtcaaagagatgaaggagactcagacagagagagacatcccaatgtctgattccctttacaggcatgacagcgacacaccctcagatagcttggatagctcctgcagttcgcctcctgcctgccaggccacagaggatgtggattacacacaagtcgtcttttctgaccctggagaactaaaaaatgactccccgctggactatgagaacataaaggaaatcacagattatgtcaatgtcaatccagaaagacacaagcccagtttctggtattttgtcaaccctgctctgtctgagccagcggaatatgatcaagtggccatgtga

SEQ ID NO: 13734 - DNA, 624 bp, Artificial Sequence
  Synthetic polypeptide
ggccgagcgcggtggctcaggtttgtaaatcccagcactttgggaggccgaggcgggcggatcacctgaggtcaggagtttgagaccagcctggccattgtggtgaaaccccgtctctaacaaaaatacaaaaattagccggccgtagtggcgggcgcctgtaattgcagctattcgggaggctgaggccggaggatcgcttgaacccgggaggcggaggttgcagtgagccgagattgcgccactgcacttccagcctgagcgacagagagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtag

SEQ ID NO: 13735 - DNA, 504 bp, Artificial Sequence
  Synthetic polypeptide
ggccgagcgcggtggctcaggtttgtaaatcccagcactttgggaggccgaggcgggcggatcacctgaggtcaggagtttgagaccagcctggccattgtggtgaaaccccgtctctaacaaaaatacaaaaattagccggccgtagtggcgggcgcctgtaattgcagctattcgggaggctgaggccggaggatcgcttgaacccgggaggcggaggttgcagtgagccgagattgcgccactgcacttccagcctgagcgacagagagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgatagtgcctcccctccctgttccccaccaggcactgcaacatggtgctggagaacgtga

SEQ ID NO: 13736 - DNA, 978 bp, Artificial Sequence
  Synthetic polypeptide
agaaaaagtatgtttttgtacagctatacaatatttatgttttaagctaagtgttattacaaaagagtcaaaattaaaatatttaaaagtttataaagtaaaaaagttacagcaagctaaggttaataaaataattttaaataaatttagtgtagcctaaatgtagtgtttataaaatcaacagtagtgtatagtaatgtcctaggcctttaccttcactcacaactcacccagagcatcttccagtcctctaaggttcatttgtggtgagtgccctatacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 13737 - DNA, 683 bp, Artificial Sequence
  Synthetic polypeptide
agaaaaagtatgtttttgtacagctatacaatatttatgttttaagctaagtgttattacaaaagagtcaaaattaaaatatttaaaagtttataaagtaaaaaagttacagcaagctaaggttaataaaataattttaaataaatttagtgtagcctaaatgtagtgtttataaaatcaacagtagtgtatagtaatgtcctaggcctttaccttcactcacaactcacccagagcatcttccagtcctctaaggttcatttgtggtgagtgccctatacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatt

SEQ ID NO: 13738 - DNA, 405 bp, Artificial Sequence
  Synthetic polypeptide
gagttcaagaccagcccggccaccatgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgatgacattccagactttgatgactag

SEQ ID NO: 13739 - DNA, 534 bp, Artificial Sequence
  Synthetic polypeptide
ggctgggcgcggtagctcacgtctgtaatcccagcactttgggaggctgaggcgggcggatcacgaggtcaggagatcaagaccatcctggataacacggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccctgcggatggacctcgctgacctgctgacacagaatccggagctgttcagaaagaatgccgaagagttcaccctccgattcggagtggaccggccctcctaa

SEQ ID NO: 13740 - DNA, 433 bp, Artificial Sequence
  Synthetic polypeptide
ggctgggcgcggtagctcacgtctgtaatcccagcactttgggaggctgaggcgggcggatcacgaggtcaggagatcaagaccatcctggataacacggagctggaggatcttcagaagaagcctcccccatacctgcggaacctgtccagcgatgatgccaatgtcctggtgtggcacgctctcctcctacccgaccaacctccctaccacctgaaagccttcaacctgcgcatcagcttcccgccggagtatccgttcaagcctcccatgatcaaattcacaaccaagatctaccaccccaacgtggacgagaacggacagatttgcctgcccatcatcagcagtgagaactggaagccttgcaccaagacttgccaagtcctggaggccctcaatgtgctggtgaatagaccgaatatcagggagcccc

SEQ ID NO: 13741 - DNA, 346 bp, Artificial Sequence
  Synthetic polypeptide
ggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaattgtggacatcggatacccaaggagacgaagctgaagcaggagaaggaggggaaaattaa

SEQ ID NO: 13742 - DNA, 323 bp, Artificial Sequence
  Synthetic polypeptide
ggcctgggcacagtggctcacacctgtaatctcaccactttgggaggccgaggtgggtggatcacgagatcagatcaagaccatcttggccaacatagtgaaaccccgtctctcctaaaaatacaaaaattagatgggtgtggtggcacatgcctgtagtcccagctactcaggaggctgaggcaggagaatcgcttgaacctgggaggcggagggttcattgagccaagatcacgccactgcactccagcctggtgacagagcgagactccatctcaaaaaaaaattgtggacatcggatacccaaggagacgaagctgaag

SEQ ID NO: 13743 - DNA, 767 bp, Artificial Sequence; identical to SEQ ID NO: 724
  Synthetic polypeptide

SEQ ID NO: 13744 - DNA, 2874 bp, Artificial Sequence
  Synthetic polypeptide
aaataggaaccctgattagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13745 - DNA, 2844 bp, Artificial Sequence
  Synthetic polypeptide
aaataggaaccctgattagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13746 - DNA, 2817 bp, Artificial Sequence
  Synthetic polypeptide
aaataggaaccctgattagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactga

SEQ ID NO: 13747 - DNA, 758 bp, Artificial Sequence
  Synthetic polypeptide
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaa

SEQ ID NO: 13748 - DNA, 581 bp, Artificial Sequence
  Synthetic polypeptide
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaa

SEQ ID NO: 13749 - DNA, 395 bp, Artificial Sequence
  Synthetic polypeptide
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcagagactgatgccgtgggtgtga

SEQ ID NO: 13750 - DNA, 647 bp, Artificial Sequence
  Synthetic polypeptide
gctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctggacctggagtggaagatcatttatgttggctcggctgagagtgaggaatttgatcagatcctagactcggtgctggtgggccctgtgccagcagggagacacatgtttgtctttcaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccaggtggggcctgtttccacttcctgcttcccacaaggccgttctttatacttggggggagttcagccattcaaattgagagtcaaggtcacttcttaa

SEQ ID NO: 13751 - DNA, 382 bp, Artificial Sequence; identical to SEQ ID NO: 434
  Synthetic polypeptide

SEQ ID NO: 13752 - DNA, 347 bp, Artificial Sequence; identical to SEQ ID NO: 452
  Synthetic polypeptide

SEQ ID NO: 13753 - DNA, 148 bp, Artificial Sequence; identical to SEQ ID NO: 454
  Synthetic polypeptide

SEQ ID NO: 13754 - DNA, 336 bp, Artificial Sequence; identical to SEQ ID NO: 7520
  Synthetic polypeptide

SEQ ID NO: 13755 - DNA, 346 bp, Artificial Sequence; identical to SEQ ID NO: 7521
  Synthetic polypeptide

SEQ ID NO: 13756 - DNA, 433 bp, Artificial Sequence; identical to SEQ ID NO: 8244
  Synthetic polypeptide

SEQ ID NO: 13757 - DNA, 433 bp, Artificial Sequence; identical to SEQ ID NO: 8245
  Synthetic polypeptide

SEQ ID NO: 13758 - DNA, 201 bp, Artificial Sequence; identical to SEQ ID NO: 6463
  Synthetic polypeptide

SEQ ID NO: 13759 - DNA, 159 bp, Artificial Sequence; identical to SEQ ID NO: 6464
  Synthetic polypeptide

SEQ ID NO: 13760 - DNA, 116 bp, Artificial Sequence
  Synthetic polypeptide
ttgttaagaggactttttattgtgtacaggggctgtgcagaatggaaaccacacttgcctgtctcccaggaagccagaaactacagggcaacaaggcaccagagtcccggacttag

SEQ ID NO: 13761 - DNA, 282 bp, Artificial Sequence; identical to SEQ ID NO: 7621
  Synthetic polypeptide

SEQ ID NO: 13762 - DNA, 285 bp, Artificial Sequence; identical to SEQ ID NO: 6477
  Synthetic polypeptide

SEQ ID NO: 13763 - DNA, 363 bp, Artificial Sequence
  Synthetic polypeptide
cagtgttgtctgttagaacattctgtgctgatgaaaatgttccatatcggtacaatacagtccagtagccactcagctaccacctgaaatgtggctagtgtcaatgaagaacagaaattgtaactttatgttaacatggtggtcttaggcaagtacctgggcatccccaagccctacgggcccatcatcaatggccgctgctgcctggaggagaaggtgcagtccctgctggagcctctgggcctgcactgcatcttcattgatgactacttgtcctaccacgagctgcagggggagatccactgtggcaccaacgtgcgcaggaagccctttcccttcaaatggtggaacatggtgccctga

SEQ ID NO: 13764 - DNA, 1086 bp, Artificial Sequence; identical to SEQ ID NO: 444
  Synthetic polypeptide

SEQ ID NO: 13765 - DNA, 564 bp, Artificial Sequence; identical to SEQ ID NO: 445
  Synthetic polypeptide

SEQ ID NO: 13766 - DNA, 987 bp, Artificial Sequence; identical to SEQ ID NO: 446
  Synthetic polypeptide

SEQ ID NO: 13767 - DNA, 432 bp, Artificial Sequence; identical to SEQ ID NO: 7545
  Synthetic polypeptide

SEQ ID NO: 13768 - DNA, 560 bp, Artificial Sequence; identical to SEQ ID NO: 6322
  Synthetic polypeptide

SEQ ID NO: 13769 - DNA, 116 bp, Artificial Sequence
  Synthetic polypeptide
ttgttaagaggactttttattgtgtccaggggctgtgcagaatggaaaccacgcttgcctgtctcccaggaagccagaaactacagggcaacaaggcaccagagtcccggacttag

SEQ ID NO: 13770 - DNA, 171 bp, Artificial Sequence; identical to SEQ ID NO: 6873
  Synthetic polypeptide

SEQ ID NO: 13771 - DNA, 633 bp, Artificial Sequence; identical to SEQ ID NO: 6874
  Synthetic polypeptide

SEQ ID NO: 13772 - DNA, 636 bp, Artificial Sequence; identical to SEQ ID NO: 6875
  Synthetic polypeptide

SEQ ID NO: 13773 - DNA, 480 bp, Artificial Sequence; identical to SEQ ID NO: 6876
  Synthetic polypeptide

SEQ ID NO: 13774 - DNA, 1325 bp, Artificial Sequence; identical to SEQ ID NO: 7686
  Synthetic polypeptide

SEQ ID NO: 13775 - DNA, 1691 bp, Artificial Sequence; identical to SEQ ID NO: 7687
  Synthetic polypeptide

SEQ ID NO: 13776 - DNA, 1541 bp, Artificial Sequence; identical to SEQ ID NO: 7688
  Synthetic polypeptide

SEQ ID NO: 13777 - DNA, 583 bp, Artificial Sequence; identical to SEQ ID NO: 7840
  Synthetic polypeptide

SEQ ID NO: 13778 - DNA, 1320 bp, Artificial Sequence; identical to SEQ ID NO: 8817
  Synthetic polypeptide

SEQ ID NO: 13779 - DNA, 420 bp, Artificial Sequence; identical to SEQ ID NO: 8818
  Synthetic polypeptide

SEQ ID NO: 13780 - DNA, 326 bp, Artificial Sequence; identical to SEQ ID NO: 6484
  Synthetic polypeptide

SEQ ID NO: 13781 - DNA, 146 bp, Artificial Sequence; identical to SEQ ID NO: 6485
  Synthetic polypeptide

SEQ ID NO: 13782 - DNA, 80 bp, Artificial Sequence; identical to SEQ ID NO: 6364
  Synthetic polypeptide

SEQ ID NO: 13783 - DNA, 217 bp, Artificial Sequence; identical to SEQ ID NO: 6365
  Synthetic polypeptide

SEQ ID NO: 13784 - DNA, 2614 bp, Artificial Sequence; identical to SEQ ID NO: 7559
  Synthetic polypeptide

SEQ ID NO: 13785 - DNA, 1747 bp, Artificial Sequence; identical to SEQ ID NO: 7560
  Synthetic polypeptide

SEQ ID NO: 13786 - DNA, 3021 bp, Artificial Sequence; identical to SEQ ID NO: 449
  Synthetic polypeptide

SEQ ID NO: 13787 - DNA, 3075 bp, Artificial Sequence; identical to SEQ ID NO: 450
  Synthetic polypeptide

SEQ ID NO: 13788 - DNA, 1143 bp, Artificial Sequence; identical to SEQ ID NO: 451
  Synthetic polypeptide

SEQ ID NO: 13789 - DNA, 768 bp, Artificial Sequence
  Synthetic polypeptide
ttttttttttttactatagattgcattaaaatgttttttatcttcatggctgaggttttgggtgcccccttaagttgtgtacctgaggtctccctgcagtacagctccaatggccagtggtaccacacctgcggagggtccctgatagccaacagctgggtcctgacggctgcccactgcatcagctcctccgggatctaccgcgtgatgctgggccagcataacctctacgttgcagagtccggctcgctggccgtcagtgtctctaagattgtggtgcacaaggactggaactccgaccaggtctccaaagggaacgacattgccctgctcaaactggctaaccccgtctccctcaccgacaagatccagctggcctgcctccctcctgccggcaccattctacccaacaactacccctgctacgtcacgggctggggaaggctgcagaccaacggggctctccctgatgacctgaagcagggccagttgctggttgtggactatgccacctgctccagctctggctggtggggcagcaccgtgaagacgaatatgatctgtgctgggggtgatggcgtgatatgcacctgcaacggagactccggtgggccgctgaactgtcaggcatctgacggccggtgggaggtgcatggcatcggcagcctcacgtcggtccttggttgcaactactactacaagccctccatcttcacgcgggtctccaactacaacgactggatcaattcggtgattgcaaataactaa

SEQ ID NO: 13790 - DNA, 383 bp, Artificial Sequence
  Synthetic polypeptide
ttttttttttttactatagattgcattaaaatgttttttatcttcatggctgaggttttgggtgcccccttaagttgtgtacctgaggtctccctgcagtacagctccaatggccagtggtaccacacctgcggagggtccctgatagccaacagctgggtcctgacggctgcccactgcatcagacaaattataaaggcccacaaggttctgcaacgttgttcacttatcctcttctttgtccgtgacctctgctcatcacagctggaactcaccggagtttctgccggctcctccgggatctaccgcgtgatgctgggccagcataacctctacgttgcagagtccggctcgctggccgtcagtgtctctaagattgtggt

SEQ ID NO: 13791 - DNA, 1084 bp, Artificial Sequence
  Synthetic polypeptide
ttaacaaacgaatctgttcaaggtggaaagtgtgaactgtatctgtgtggactggaaaggtggctcccgaactggatacacacaagcctcgcagaacatcaggatcgtgggagcagaagtggcatattttgttgaatttcttcagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttag

SEQ ID NO: 13792 - DNA, 871 bp, Artificial Sequence; identical to SEQ ID NO: 437
  Synthetic polypeptide

SEQ ID NO: 13793 - DNA, 421 bp, Artificial Sequence; identical to SEQ ID NO: 441
  Synthetic polypeptide

SEQ ID NO: 13794 - DNA, 638 bp, Artificial Sequence; identical to SEQ ID NO: 442
  Synthetic polypeptide

SEQ ID NO: 13795 - DNA, 337 bp, Artificial Sequence; identical to SEQ ID NO: 443
  Synthetic polypeptide

SEQ ID NO: 13796 - DNA, 148 bp, Artificial Sequence; identical to SEQ ID NO: 6388
  Synthetic polypeptide

SEQ ID NO: 13797 - DNA, 1100 bp, Artificial Sequence; identical to SEQ ID NO: 6389
  Synthetic polypeptide

SEQ ID NO: 13798 - DNA, 464 bp, Artificial Sequence; identical to SEQ ID NO: 6390
  Synthetic polypeptide

SEQ ID NO: 13799 - DNA, 280 bp, Artificial Sequence; identical to SEQ ID NO: 6391
  Synthetic polypeptide

SEQ ID NO: 13800 - DNA, 943 bp, Artificial Sequence; identical to SEQ ID NO: 9889
  Synthetic polypeptide

SEQ ID NO: 13801 - DNA, 387 bp, Artificial Sequence; identical to SEQ ID NO: 544
  Synthetic polypeptide

SEQ ID NO: 13802 - DNA, 540 bp, Artificial Sequence; identical to SEQ ID NO: 545
  Synthetic polypeptide

SEQ ID NO: 13803 - DNA, 303 bp, Artificial Sequence; identical to SEQ ID NO: 547
  Synthetic polypeptide

SEQ ID NO: 13804 - DNA, 2471 bp, Artificial Sequence; identical to SEQ ID NO: 576
  Synthetic polypeptide

SEQ ID NO: 13805 - DNA, 653 bp, Artificial Sequence
  Synthetic polypeptide
ttagctacacattaaagcgacctaagacagagtttttgaaaatactgatgcctgtgtcctaccccagggcaattaactcaaacttctcaggaagacagtgtgaataccaccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaa

SEQ ID NO: 13806 - DNA, 406 bp, Artificial Sequence
  Synthetic polypeptide
ttagctacacattaaagcgacctaagacagagtttttgaaaatactgatgcctgtgtcctaccccagggcaattaactcaaacttctcaggaagacagtgtgaataccaccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 13807 - DNA, 1597 bp, Artificial Sequence
  Synthetic polypeptide
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13808 - DNA, 1606 bp, Artificial Sequence
  Synthetic polypeptide
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacagttccacgagacccatccactgtggaggacaagtgtgagaaggcctgccgccccgaggaggagtgccttgccctcaacagcacctggggctgtttctgcagacaggacctcaatagttctgatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagccttcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13809 - DNA, 376 bp, Artificial Sequence
  Synthetic polypeptide
cagtggttctcaactgggggcgatgccccccaagaagacatttggcaatgcctggagaccactttggggcatgctggtgggatctggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagacgctcccatgtggctgaatgggacccaccctgccctt

SEQ ID NO: 13810 - DNA, 1100 bp, Artificial Sequence
  Synthetic polypeptide
taaaatcatttataccgtatttttgctgtatgtttttaggtttagatatatttggatacacaactagttacgttgtgttccagttgcctagagtacacagaacagtaacatgctgtacagatttgtagcctaggagcaacaggctgtaccacacagcccagtcggcgttcggttactcaccttccaatgtgcatgtcattggccacagcctgggtgcccacgctgctggggaggctggaaggagaaccaatgggaccattggacgcatcacagggttggacccagcagaaccttgctttcagggcacacctgaattagtccgattggaccccagcgatgccaaatttgtggatgtaattcacacggatggtgcccccatagtccccaatttggggtttggaatgagccaagtcgtgggccacctagatttctttccaaatggaggagtggaaatgcctggatgtaaaaagaacattctctctcagattgtggacatagacggaatctgggaagggactcgagactttgcggcctgtaatcacttaagaagctacaaatattacactgatagcatcgtcaaccctgatggctttgctggattcccctgtgcctcttacaacgtcttcactgcaaacaagtgtttcccttgtccaagtggaggctgcccacagatgggtcactatgctgatagatatcctgggaaaacaaatgatgtgggccagaaattttatctagacactggtgatgccagtaattttgcacgttggaggtataaggtatctgtcacactgtctggaaaaaaggttacaggacacatactagtttctttgttcggaaataaaggaaactctaagcagtatgaaattttcaagggcactctcaaaccagatagtactcattccaatgaatttgactcagatgtggatgttggggacttgcagatggttaaatttatttggtataacaatgtgatcaacccaactttacctagagtgggagcatccaagattatagtggagacaaatgttggaaaacagttcaacttctgtagtccagaaaccgtcagggaggaagttctgctcaccctcacaccgtgttag

SEQ ID NO: 13811 - DNA, 117 bp, Artificial Sequence; identical to SEQ ID NO: 8388
  Synthetic polypeptide

SEQ ID NO: 13812 - DNA, 333 bp, Artificial Sequence; identical to SEQ ID NO: 6583
  Synthetic polypeptide

SEQ ID NO: 13813 - DNA, 346 bp, Artificial Sequence; identical to SEQ ID NO: 7074
  Synthetic polypeptide

SEQ ID NO: 13814 - DNA, 470 bp, Artificial Sequence
  Synthetic polypeptide
ctgagacagtgagagtggggaggcctccaaatgcttggcttttcggcccagctctgtcagtcacggtgaaaccttgggcaagccacttccgaacctcagtttcctcatctgtaaaatggaaacactgttggtgaagactaaaagaggtgaaagccaacggggctgttcctgatgtcctgcagcagggccggttgctggttgtggactatgccacctgctccagctctgcctggtggggcagcagcgtgaaaaccagtatgatctgtgctgggggtgatggcgtgatctccagctgcaacggagactctggcgggccactgaactgtcaggcgtctgacggccggtggcaggtgcacggcatcgtcagcttcgggtctcgcctcggctgcaactactaccacaagccctccgtcttcacgcgggtctccaattacatcgactggatcaattcggtgattgcaaataactaa

SEQ ID NO: 13815 - DNA, 1078 bp, Artificial Sequence
  Synthetic polypeptide
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggtacggggtggagcccgcggtccctggtgtgcgtggtgccggacgtggcggccttctgcagcgactggcgctggctgcgcgctcccatcacaatccccatgagcctggtgcgcgccgacgggctcttctaccctag

SEQ ID NO: 13816 - DNA, 1213 bp, Artificial Sequence
  Synthetic polypeptide
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 13817 - DNA, 1216 bp, Artificial Sequence
  Synthetic polypeptide
gggcacggtggctcatgcctgtaatcccaacaatttgggaggccaaggtgggcggatcagttgatcccagaagttcaagactagctagggcaacatggcgaaatcttgtctgtaccaaaaaaaaaaaaaaaaaaagaaaaagaaaaattagcctggcatggtggcctgcacttgttgtcccagctacgtgggaggctgagatcagaagatcacttgaacccaagaggtcgaggctgcagtgagctgtgatagcaccacggcagtccagcctgggtgacaggtgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttag

SEQ ID NO: 13818 - DNA, 186 bp, Artificial Sequence
  Synthetic polypeptide
ttgttaagaggactttttattgtgtccaggggctgtgcagaatggaaaccacgcttgcctgtctcccaggaagccaggtgaggccgtgcgctgatttctggctgtggcagaagagatgcctacaaatttcaggttgaccatgtaaagaaactacagggcaacaaggcaccagagtcccggacttag

SEQ ID NO: 13819 - DNA, 214 bp, Artificial Sequence
  Synthetic polypeptide
tcttcagagcctggcatggagcctgtcttgctcaagaagtcaagtccgcagtgaagtaccggccatcgacctagcccgggttctagatttggggcccatcactcggagaggtgcacagtctcccggtgtcatgaatggaacccctagcactgcagggttcctggtggcctggcctatggtcctcctgactgtcctcctggcttggctgttctga

SEQ ID NO: 13820 - DNA, 459 bp, Artificial Sequence; identical to SEQ ID NO: 6625
  Synthetic polypeptide

SEQ ID NO: 13821 - DNA, 571 bp, Artificial Sequence; identical to SEQ ID NO: 10039
  Synthetic polypeptide

SEQ ID NO: 13822 - DNA, 145 bp, Artificial Sequence
  Synthetic polypeptide
ggtggctcacgcctgtaatccaggcactttgggaggtcaagatgggcagatcaccagaggtcaggagttcgagaccagcctggtcaacacggggaaaccccgtctctactaaaaatacaaaaataaggtgattgcaaataactaa

SEQ ID NO: 13823 - DNA, 1775 bp, Artificial Sequence; identical to SEQ ID NO: 568
  Synthetic polypeptide

SEQ ID NO: 13824 - DNA, 841 bp, Artificial Sequence
  Synthetic polypeptide
ggccaagtgcggtggctaacgcctgtaatcccagcactttgggaggccgaggaaggtggatcacccgagatcaggagtttgggaccagcctggccaacatggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggccccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactga

SEQ ID NO: 13825 - DNA, 524 bp, Artificial Sequence
  Synthetic polypeptide
ggccaagtgcggtggctaacgcctgtaatcccagcactttgggaggccgaggaaggtggatcacccgagatcaggagtttgggaccagcctggccaacatggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggct

SEQ ID NO: 13826 - DNA, 311 bp, Artificial Sequence
  Synthetic polypeptide
gcattagaatcagctggagtgtttataaagcatgcagattcctgatccccagctcatatctaaaaataaaaatatctatggatagggccaggaaatctgcatttttataatgtcatcaagtgattctcagtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaa

SEQ ID NO: 13827 - DNA, 469 bp, Artificial Sequence
  Synthetic polypeptide
ttatcacatttattatttattgtttttctctcccactaggttgtaagctccatgagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttga

SEQ ID NO: 13828 - DNA, 235 bp, Artificial Sequence
  Synthetic polypeptide
ttatcacatttattatttattgtttttctctcccactaggttgtaagctccatgagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagcaaaaacaaagagtgtga

SEQ ID NO: 13829 - DNA, 1130 bp, Artificial Sequence; identical to SEQ ID NO: 8820
  Synthetic polypeptide

SEQ ID NO: 13830 - DNA, 1280 bp, Artificial Sequence; identical to SEQ ID NO: 8821
  Synthetic polypeptide

SEQ ID NO: 13831 - DNA, 1277 bp, Artificial Sequence; identical to SEQ ID NO: 8822
  Synthetic polypeptide

SEQ ID NO: 13832 - DNA, 201 bp, Artificial Sequence
  Synthetic polypeptide
gtgggagccacaccggatgtgagctggaagacctgggctctgcctcctcttggctgcgtggacttgggagggtcactcccctccccgagcctcatcagttccatttatgaagtaggggaccaggagctggagagcctgtcggccattgaagcagagctggagaaagtggcccaccagctgcaggcactacggcggggctga

SEQ ID NO: 13833 - DNA, 181 bp, Artificial Sequence; identical to SEQ ID NO: 10485
  Synthetic polypeptide

SEQ ID NO: 13834 - DNA, 456 bp, Artificial Sequence; identical to SEQ ID NO: 6649
  Synthetic polypeptide

SEQ ID NO: 13835 - DNA, 480 bp, Artificial Sequence; identical to SEQ ID NO: 6650
  Synthetic polypeptide

SEQ ID NO: 13836 - DNA, 186 bp, Artificial Sequence; identical to SEQ ID NO: 6651
  Synthetic polypeptide

SEQ ID NO: 13837 - DNA, 473 bp, Artificial Sequence
  Synthetic polypeptide
tgctgtggtttgagtatttgttccctccagaactcacattgaaatttaattcctaatgtgcaattattgagaggtggggcctttaagaagtgattgggtcatgaatagattaatccattcatagcttaatgggtaaatggattaatggatcatcacgggagaggaactggtggctttataagaggaaaacagacctaagcttagcatgctcagccgacttgtcatgtgatgccctgtgctgcctgatgactctgcagagtctctatgtaaaaagatcagcaagatggtccgcaccagatgtggctccttgaccttggacttcttagttcccatgatggtcgggaaagaggttaaagaagacacgcaagtatgatatcatcaccactccagcagagcgagtggaaatggcgccactaaatgaagaggatgatgaagatgaggactccacagtattcgacatcaaatacaggtaa

SEQ ID NO: 13838 - DNA, 336 bp, Artificial Sequence; identical to SEQ ID NO: 7520
  Synthetic polypeptide

SEQ ID NO: 13839 - DNA, 346 bp, Artificial Sequence; identical to SEQ ID NO: 7521
  Synthetic polypeptide

SEQ ID NO: 13840 - DNA, 2046 bp, Artificial Sequence; identical to SEQ ID NO: 8788
  Synthetic polypeptide

SEQ ID NO: 13841 - DNA, 2100 bp, Artificial Sequence; identical to SEQ ID NO: 8789
  Synthetic polypeptide

SEQ ID NO: 13842 - DNA, 2124 bp, Artificial Sequence; identical to SEQ ID NO: 8790
  Synthetic polypeptide

SEQ ID NO: 13843 - DNA, 2100 bp, Artificial Sequence; identical to SEQ ID NO: 8791
  Synthetic polypeptide

SEQ ID NO: 13844 - DNA, 2016 bp, Artificial Sequence; identical to SEQ ID NO: 8792
  Synthetic polypeptide

SEQ ID NO: 13845 - DNA, 2124 bp, Artificial Sequence; identical to SEQ ID NO: 8793
  Synthetic polypeptide

SEQ ID NO: 13846 - DNA, 2007 bp, Artificial Sequence; identical to SEQ ID NO: 8794
  Synthetic polypeptide

SEQ ID NO: 13847 - DNA, 663 bp, Artificial Sequence; identical to SEQ ID NO: 8795
  Synthetic polypeptide

SEQ ID NO: 13848 - DNA, 718 bp, Artificial Sequence; identical to SEQ ID NO: 12403
  Synthetic polypeptide

SEQ ID NO: 13849 - DNA, 616 bp, Artificial Sequence; identical to SEQ ID NO: 12404
  Synthetic polypeptide

SEQ ID NO: 13850 - DNA, 1290 bp, Artificial Sequence; identical to SEQ ID NO: 6392
  Synthetic polypeptide

SEQ ID NO: 13851 - DNA, 215 bp, Artificial Sequence; identical to SEQ ID NO: 10664
  Synthetic polypeptide

SEQ ID NO: 13852 - DNA, 188 bp, Artificial Sequence; identical to SEQ ID NO: 10665
  Synthetic polypeptide

SEQ ID NO: 13853 - DNA, 146 bp, Artificial Sequence; identical to SEQ ID NO: 10666
  Synthetic polypeptide

SEQ ID NO: 13854 - DNA, 871 bp, Artificial Sequence; identical to SEQ ID NO: 437
  Synthetic polypeptide

SEQ ID NO: 13855 - DNA, 421 bp, Artificial Sequence; identical to SEQ ID NO: 441
  Synthetic polypeptide

SEQ ID NO: 13856 - DNA, 638 bp, Artificial Sequence; identical to SEQ ID NO: 442
  Synthetic polypeptide

SEQ ID NO: 13857 - DNA, 337 bp, Artificial Sequence; identical to SEQ ID NO: 443
  Synthetic polypeptide

SEQ ID NO: 13858 - DNA, 805 bp, Artificial Sequence; identical to SEQ ID NO: 8823
  Synthetic polypeptide

SEQ ID NO: 13859 - DNA, 1229 bp, Artificial Sequence
  Synthetic polypeptide
cctcctgggcttatggagattttgcatggagtaaccccctgcatccagatatcttcccaggactacgcaagatagaggcagaaatcgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactga

SEQ ID NO: 13860 - DNA, 182 bp, Artificial Sequence
  Synthetic polypeptide
cctcctgggcttatggagattttgcatggagtaaccccctgcatccagatatcttcccaggactacgcaagatagaggcagaaatcgtgaggatagcttgttccctgttcaatgggggaccagattcgtgtggatgtgaagcattgtttttgttttgtttttctaatatgttggcgccatga

SEQ ID NO: 13861 - DNA, 188 bp, Artificial Sequence
  Synthetic polypeptide
cctcctgggcttatggagattttgcatggagtaaccccctgcatccagatatcttcccaggactacgcaagatagaggcagaaatcgtgaggatagcttgttccctgttcaatgggggaccagattcgtgtggatgtgtaagtatatgcaaggggcatccaatagccttattttttaggttaaaatag

SEQ ID NO: 13862 - DNA, 376 bp, Artificial Sequence; identical to SEQ ID NO: 6329
  Synthetic polypeptide

SEQ ID NO: 13863 - DNA, 1196 bp, Artificial Sequence
  Synthetic polypeptide
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13864 - DNA, 1136 bp, Artificial Sequence
  Synthetic polypeptide
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13865 - DNA, 1118 bp, Artificial Sequence
  Synthetic polypeptide
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13866 - DNA, 1193 bp, Artificial Sequence
  Synthetic polypeptide
tgatatggtctggctgtgtccccacccaaatctcatcttgaattgtagctcccacaattcctacaggtcatgggagggactcagtgggaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaa

SEQ ID NO: 13867 - DNA, 147 bp, Artificial Sequence; identical to SEQ ID NO: 6327
  Synthetic polypeptide

SEQ ID NO: 13868 - DNA, 29 bp, Artificial Sequence
  Synthetic polypeptide
agaccctgagcctaggaaccacagaataa

SEQ ID NO: 13869 - DNA, 546 bp, Artificial Sequence; identical to SEQ ID NO: 8836
  Synthetic polypeptide

SEQ ID NO: 13870 - DNA, 913 bp, Artificial Sequence
  Synthetic polypeptide
atctgtaagaagatgataaggatagtatctgcctcaaagaactgatgtaagggttaattaagcattatatataaagcacttgaaatcgggctcggccctcagtcagcactcagtaaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggagtggacattgtcatggaccctctgggtgggtcagatactgccaagggctacaacctcctgaaacccatgggcaaagtcgtcacctatggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtggctgatgccatgaaacagatgcaggagaagaagaatgtgggcaaggtcctcctggttccagggccagagaaggagaactag

SEQ ID NO: 13871 - DNA, 169 bp, Artificial Sequence
  Synthetic polypeptide
atctgtaagaagatgataaggatagtatctgcctcaaagaactgatgtaagggttaattaagcattatatataaagcacttgaaatcgggctcggccctcagtcagcactcagtaaaggcaggagaccgggtgatggtgttgaaccggtcagggatgtggcaggaagag

SEQ ID NO: 13872 - DNA, 433 bp, Artificial Sequence; identical to SEQ ID NO: 10655
  Synthetic polypeptide

SEQ ID NO: 13873 - DNA, 2865 bp, Artificial Sequence
  Synthetic polypeptide
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaa

SEQ ID NO: 13874 - DNA, 396 bp, Artificial Sequence
  Synthetic polypeptide
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgg

SEQ ID NO: 13875 - DNA, 575 bp, Artificial Sequence
  Synthetic polypeptide
aatgagtatgagagggaaagctgagaaggagaagaccggagatgaggcgtgggaggggccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcat

SEQ ID NO: 13876 - DNA, 1412 bp, Artificial Sequence
  Synthetic polypeptide
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcgggaaggaccccacgccctccatgctgggcctctgcggctccctggcctccattcccagctgcaagtccctggcgagcttcaaatccaacgagtgcctggtgagcgacagtcccgagggcagcccagcactgagccccagctga

SEQ ID NO: 13877 - DNA, 1274 bp, Artificial Sequence
  Synthetic polypeptide
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattag

SEQ ID NO: 13878 - DNA, 1289 bp, Artificial Sequence
  Synthetic polypeptide
acagatgtagcagaaagagcagaagcttcagaatcagaatcagacatacctgcttgactactcataagccatgtgactccgaacagatcagtcaacctcttggaccatcaatttctttacctgtaaaatggggatgagagtaatactaagaggacctacctttcagggctgagcatgggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattag

SEQ ID NO: 13879 - DNA, 691 bp, Artificial Sequence
  Synthetic polypeptide
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtatggaaacccatttcgagccttttattttaccactcacaaacgctccacagaaaggtcagtcgtatagagtagacagatttatgaatggtgatttttaa

SEQ ID NO: 13880 - DNA, 667 bp, Artificial Sequence
  Synthetic polypeptide
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcaggtgcgaggatagctacaagccatggactttctgtcctgcttcttgtttgtggctttgtgaagggtgctttgctttaa

SEQ ID NO: 13881 - DNA, 886 bp, Artificial Sequence
  Synthetic polypeptide
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagtgtctccaatccttccagaagtcaaacatctccacagaccacctctactagtccttcctttcttctctctgtcttcacttttttctactgacccccttcccaccttcccaacgtcacacagaactgtgaagcggcttcctgctcctcttccccaacctggccatggatcaacccctggtgtgcagagctgcgtgctggctcctccagcaaagagcaaatcgcctgtaaaatctacggagcggacagcaaagttgaccctaaactccaagcaccaccctgcacccactgtactctaa

SEQ ID NO: 13882 - DNA, 679 bp, Artificial Sequence
  Synthetic polypeptide
agtaaatgttgtggaatactgcaatctgacaaaagcaaaatttaccgagtttccgcggaacgtgacggcgaccgaggggcagaatgtggagatgtcctgcgccttccagagcggctccgcctcggtgtatctggagatccaatggtggttcctgcgggggccggaggacctggatcccggggccgagggggccggcgcgcaggtggagctcttgcccgacagagacccggacagcgacgggaccaagatcagcacagtgaaagtccaaggcaatgacatctcccacaagcttcagatttccaaagtgaggaaaaaggatgaaggcttatatgagtgcagggtgactgatgccaactacggggagcttcaggaacacaaggcccaggcctatctgaaagtcaatgccaacagccatgcccgcagaatgcaggccttcgaagcctcgcccatgtggctgcaggatatgaagccccgcaagaacgtctccgcagccatccccagcagcatccatggctctgccaaccaacgaacgcactccacctccagccctcaagtggtagccaaaatccccaaacaaagtccacaatcagcaaagagcaaatcgcctgtaaaatctacggagcggacagcaaagttgaccctaaactccaagcaccaccctgcacccactgtactctaa

SEQ ID NO: 13883 - DNA, 1721 bp, Artificial Sequence
  Synthetic polypeptide
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgaggtcgcagcctgacttggagtatgggggtccttacgcctggacaaatggttatgatggagaattgtatggatcacagtccctgaatagaagatctggcaggccctcctgtctgtacagcgctgcccggccttcggggagttaccgggcgtctgtgttggatgaaggcagcttcggtgggacccgacggggcagcacctccggctcccgtgctccctcggagtacagcggccacctcaactccagctcccgcgcctcctccagggccagctcggcccgggccagccctgtggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgaggaaatccgacagctacagcagaaacaggcgagttctatcagggagatttctgatcttcaggaaacaatagagtggaaagacaaaaagataggggcattagagaggcagaaagagttctttgattccgtaaggagtgaacgggatgatcttagagaagaagtagtcatgctgaaagaggaattaaagaaacatggaataatcctaaattcagaaatagctaccaatggagagacttccgacaccctcaataatgttggataccaaggtcctaccaagatgacaaaagaagagttaaatgccctcaagtcgacaggggatgggaccctagatattaggttgaaaaagctggttgatgaacgggaatgcttattggaacagattaagaaactcaaagggcagctggaggagagacagaagattggcaaactagacaatcttcgatctgaagatgatgtcttggaaaacgggacagacatgcatgtaatggacctacaaagggatgccaacagacagatcagcgacctcaaatttaaacttgcaaaatctgagcaagagataactgcattagaacaaaatgtaataaggttagagagtcaagtatcacgttacaaatcagcggctgaaaatgcagaaaaaatagaagatgaacttaaggcagaaaaacggaaactccaaagagagctccgctctgcattggataaaacagaagagctcgaggtgagcaacggccacttagtgaagcgtctggaaaaaatgaaagcaaatcggagtgcactcttgtcccagcagtaa

SEQ ID NO: 13884 - DNA, 2249 bp, Artificial Sequence
  Synthetic polypeptide
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaa

SEQ ID NO: 13885 - DNA, 341 bp, Artificial Sequence
  Synthetic polypeptide
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgaggacaaatggttatgatggagaattgtatggatcacagtccctgaatagaagatctggcagggtagaagagagaccagaaaaagattttactgagaaggggtctcgtaacatgccgggcctgtctgcagccacgctggcctctctgggtgggacttcctctcggagaggcagcggagacacctccatctccatcgacacc

SEQ ID NO: 13886 - DNA, 2321 bp, Artificial Sequence
  Synthetic polypeptide
tctctcttcatcttgtccgctgtgcctgccgaaaccactggtctttggaagacagtgagcgctactctcgtagatccagaagaaacacatcggcttctgatgaagacgagcgcatgtcagtgggtagtcgtggaagcctgagggtagaagagagaccagaaaaagattttactgagaaggggtctcgtaacatgccgggcctgtctgcagccacgctggcctctctgggtgggacttcctctcggagaggcagcggagacacctccatctccatcgacaccgaggcatccatcagggaaatcaaggaactcaatgagttaaaggaccagattcaggatgtagaaggcaaatacatgcagggattgaaagagatgaaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagaatttgaaagggaaaaacacgcccacagtatactgcaatttcagtttgctgaagtcaaggaggccctgaagcaaagagaggaaatgctcgagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaa

SEQ ID NO: 13887 - DNA, 244 bp, Artificial Sequence; identical to SEQ ID NO: 10605
  Synthetic polypeptide

SEQ ID NO: 13888 - DNA, 467 bp, Artificial Sequence; identical to SEQ ID NO: 10606
  Synthetic polypeptide

SEQ ID NO: 13889 - DNA, 1182 bp, Artificial Sequence
  Synthetic polypeptide
cagaagaacaaaacaggttctacagtcacttcagtatatcatttacaatgtgcaaaaagtttcagagatgcaaactaaaatgagaaagtatgaccaatactctgaaaaaaataagttaatagaaaccgattcaagtaggtccagatgttggatttagcagccaaagactgcaaagccactattacaaatacattcaaaggcttaagaaaaatgtattcaatgaattaaaagaaaacatggtatccatgagtgaagagctatggaatctcagcagagaaatagaaacactccagcccccacggaaattctagagctgaaaagtataataaatgaaatgaaaatcatttaaatgtactcaacaacaattttgagatgaaaacagaacatttgaacagaaaatgcagtgaatttgaagatagatcaagagagaatagttaatcaaaagaacaggagccaaaaagattgaaaaataaccaaagtcacagacctatgtaacattaagtagttcaacacatgcataattttagtattagatgtaatgaaaaaaagaacattaccgaaaaaatattgaagaaatgttggccaaaaatttctcaagtttgataaaagctactaacttagagatccgctaagctcaacaaatccaactgagtgaagcccaaagaaaaccaaagcaaggaacattatagtcacaacggtaaaatcaaagattaagagaaaatcttgaaaataagagaaaaaaatgatgtgctatataaacatctgacttcccaacataaatagtggaaattatcagacactggaatgattattcaaagtgctgaagaagaaaaatcaacaattctctatttaatgaaactatctttttaaaatggaggccaaaaatacattttccagatcaacaaaatctaagataatttgttggtaacaggtttatacttcaagatggacaagaagttctatcagctgctgagaaatgatgccagatggtaactcagatatacaagaaatactcaaatgtgctggaaatggcctggttgcagtatgcttgaaatctgggatgtggaagacccttccaatgcagctaaccctcccttatgtagcgtcctgctcgaagacgccaggccttacttcaccacagtatttcagaatagtgtgtacagagtattaaaggttaactga

SEQ ID NO: 13890 - DNA, 769 bp, Artificial Sequence; identical to SEQ ID NO: 6486
  Synthetic polypeptide

SEQ ID NO: 13891 - DNA, 941 bp, Artificial Sequence
  Synthetic polypeptide
cagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccagcggaaaatccgccagagctactttgcctctgtgtcatatttggatacacaggtcggccgcctcttgagtgctttggacgatcttcagctggccaacagcaccatcattgcatttacctcggatcatgggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttga

SEQ ID NO: 13892 - DNA, 320 bp, Artificial Sequence
  Synthetic polypeptide
cagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccagcggaaaatccgccagagctactttgcctctgtgtcatatttggatacacaggtcggccgcctcttgagtgctttggacgatcttcagctggccaacagcaccatcattgcatttacctcggatcatggtttcctcatgaggacaaatacctga

SEQ ID NO: 13893 - DNA, 173 bp, Artificial Sequence; identical to SEQ ID NO: 10896
  Synthetic polypeptide

SEQ ID NO: 13894 - DNA, 159 bp, Artificial Sequence; identical to SEQ ID NO: 10897
  Synthetic polypeptide

SEQ ID NO: 13895 - DNA, 357 bp, Artificial Sequence; identical to SEQ ID NO: 10751
  Synthetic polypeptide

SEQ ID NO: 13896 - DNA, 516 bp, Artificial Sequence
  Synthetic polypeptide
gctgagcatagagagactcaggtgacaatcagaaaagagagagctgaggccattgaccatggctggcttgggcattctctgcctatatgccttgtacaatcactctgcctcaccaagcctgattcctcatttgtaaaatcgacatcatgatacccactcccagaagttgttcttcccaatggcataggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtga

SEQ ID NO: 13897 - DNA, 446 bp, Artificial Sequence
  Synthetic polypeptide
gctgagcatagagagactcaggtgacaatcagaaaagagagagctgaggccattgaccatggctggcttgggcattctctgcctatatgccttgtacaatcactctgcctcaccaagcctgattcctcatttgtaaaatcgacatcatgatacccactcccagaagttgttcttcccaatggcataggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaa

SEQ ID NO: 13898 - DNA, 560 bp, Artificial Sequence; identical to SEQ ID NO: 6321
  Synthetic polypeptide

SEQ ID NO: 13899 - DNA, 271 bp, Artificial Sequence; identical to SEQ ID NO: 8953
  Synthetic polypeptide

SEQ ID NO: 13900 - DNA, 60 bp, Artificial Sequence; identical to SEQ ID NO: 8954
  Synthetic polypeptide

SEQ ID NO: 13901 - DNA, 808 bp, Artificial Sequence
  Synthetic polypeptide
gcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagcttgcagttccccacaatgatgaatggacccgatttgccaggacccttgtggaaattcgtgctaacagagctgatagcgaggaggaaggcactgttgagttatctgcctag

SEQ ID NO: 13902 - DNA, 790 bp, Artificial Sequence
  Synthetic polypeptide
gcttttaactatatgaaaagataacaacctcatttataagagaaattaaaattaaaaccaagttgagaaacatatttccaactatcagattgacaaaaatctaagttttgcaacatactctgtgatgaggccgaaagaaaccagctgttctcatacatttccattggaaatgcaaaatggctcaacactgtggaagaggatttagcaatatctaaaaataatacatgttttaacagaacaatttccacttctaggaatctatgccaaagatataccagcaaaaataagacagaagacatatggagaaggacattcactgaaagattatttgaatagcaaaagaatgaatacaactcaaaaatctctatcagtacagtgctgtgtgaatcaaaagtatggtacctccacccaagagagtaacattattcagcacaacaagccgctctactcctttgaagacaatgcagactatgtgtacgatgtcatgtggtcccccgtgcatcctgcgctttttgcctgcgtggacgggatggggcgcttggacctctggaacctcaacaatgacaccgaggttccaacagcaagtgtggccattgagggggcatccgccctaaaccgtgttcgttgggcccaagctggcaaagaagttgctgttggggactcggaaggccgtatttgggtctatgacgttggagagggtcttgctatgttgccaggctggtctcaaaattcctggactcaagcaatcctcctatgttggcctcccaaagtgctgggattacagacatga

SEQ ID NO: 13903 - DNA, 947 bp, Artificial Sequence; identical to SEQ ID NO: 6434
  Synthetic polypeptide

SEQ ID NO: 13904 - DNA, 881 bp, Artificial Sequence; identical to SEQ ID NO: 6435
  Synthetic polypeptide

SEQ ID NO: 13905 - DNA, 7248 bp, Artificial Sequence
  Synthetic polypeptide
ttaacagaaacaatggaagccaaaagaaagaaaacaactgccacctagaattctctactcaatacgtatatcttttaataaggaaggtgaaataaaactattttcaggaaataaaaattaagggaatttgtcaccagcagactctcactaaaggaaaaactaaaaaggagttcttcaggcagaaggaaaatgattcccgatggaagctcagagatacaggaagtaatgaagaacagtggaaagcatttgttcagtgctcagcacaggagtttgaccagacagagtagacgtcaaatatgtaccagtagtttgatggaacgtttcttacaggatgtactgcagcaccacccatatcattgtcaagagagcagttcaacacaagatgagacacatgtgaatactgggtcatcgtctgaagtggtgcatttggatgatgctttttctgaagaagaggaagaggatgaggataaggttgaggatgaggatgctaccgaagagagaccatccgaggtttcagaacctattgaagagttacattccagacctcataaatctcaggaaggcacgcaggaggtttcagttcgaccatcagttattcaaaaactggagaagggacagcagcagcccttggagtttgttcataaaattggggccagtgtgagaaaatgtaacctagtagatattggtcaggctacaaataatagaagcaacttggtacgccccccagtgatttgtaatgctcctgctagttgtttacctgaaagctctaacgatagaccagttacagctaatacaactagtttaccaccagcagctcatttggattcagttagcaaatgtgacccaaacaaagttgagaaatatcttgaacagccagatggggcctctagaaatcctgtgccatcatcccatgtagaaactacttcattttcgtatcagaaacataaagaatcaaataggaaatctttacgcatgaattcagataagttggttttgtggaaagatgtaaaatctcagggtaaaactttatcagctggcttgaaattccatgaacgcatgggtactaagggctccttaagagttaaatctccttccaaattagcagtaaacccgaataaaactgacatgccttctaataaaggaatctttgaagatactattgcaaagaaccatgaggaattcttttctaacatggattgtacccaagaagaaaagcatttggtttttaacaagacagccttttgggaacagaagtgctcagtgagttctgaaatgaagtttgattgtatctctcttcagtcagcatctgatcagccccaagagactgcacaagacttaagtctttggaaggaggagcaaattgaccaagaagataactatgagtctagaggttcagaaatgagttttgattgcagttcctcttttcattcactgactgaccaatctaaagtgagtgccaaagaagtaaacctttccaaggaagtacgtactgatgtacagtataagaataataaatcttatgtttctaaaataagttctgattgtgatgacattcttcacttggttaccaaccaatcccaaatgattgttaaagaaataagtcttcagaatgcaaggcatattagcctggttgaccaaagctatgaatctagtagttctgaaacgaattttgattgtgatgcttcacctcagtccactagtgactacccccaacaatctgtaacagaagtaaaccttcctaaggaagtgcacattggtttggttgataagaactatggttccagtagctctgaagtaagtgctgattctgttttcccactgcagtcagtggttgacagacccccagtggctgtcacagaaacaaaacttcggaagaaggctcataccagcttggttgataactatggatcgagttgttctgaaacaagttttgattgtgatgtttctcttgagtcagtagttgatcatccccaactgactgtcaaaggaagaaacctgaaaggtagacaagtccacctaaaacataagaagcgtaaacccagtagtgctaaagcacatcttgattgtgatgtctcacttgggacagttgcagatgaatcccagagggctgttgaaaagataaatcttctgaaggagaagaatgctgaccttatggatatgaactgtgaatcccatggtcctgaaatgggttttcaggctgatgctcaattagctgaccagtctcaagtagccgaaatagagcgtcagaaagtggatgttgaccttgagaataagagtgttcagtctagccgttcttctctgagttctgattctccggcttctctttatcattcagctcatgatgagcctcaagaagctttggatgaagtaaatcttaaagagttaaatattgacatggaagttaggagctatgattgctccagctctgagttgacttttgattctgacccgcctcttctgtcagttactgagcagtctcatctggatgctgaaggaaaagaacggcacattgacctggaagatgagagctgtgagtcagatagttctgaaataacttttgattctgatattcctctttattcagtaattgaccaacctgaagtagctgtttatgaggaagaaactgttgatctggaaagtaaaagtaatgaatcttgtgtctctgaaataacttttgattctgatattcctcttcattcaggaaatgatcaccctgaagtagctgttaaagaagtaattcagaaagaagagtacattcacttagaaaggaagaatgatgaacccagtggttctgaaataagttcggattcccatgcccctcttcattcagtgactaattctcccgaagtagctgttaaaaagctaaatcctcaaaaagaagagcaggtacacttagaaaataaggaaaatgaacctattgattctgaagtaagtttggattataatatcatttttcattcagtgactggacgttctgaagatcccattaaagaaataagccttcacacaaaagagcacatgtacttagaaaataagagtgtttttgaaacaagtttggattctgatgtccctcttcaggcagcgactcacaaacctgaagtaattgtcaaagaaacatggcttcaaagagaaaagcacgctgaattccaaggtagaagtactgaattcagtggttcaaaaacaagtttagattctggtgtccctcattattcagtaactgaacctcaagtagctgttaacaaaataaacagaaagaagcaatatgttctagaaaacaagaatgataaatgtagtggttctgaaataattttggattctaatgttccacctcagtcaatgactgaccaacctcaactagcttttttgaaggaaaaacatgttaatctgaaggacaaaaacagtaaatcaggtgattctaaaataacttttgattctgaacaacttcaggaagcggttaaaaaaatagaccaatggaaggaagaggttattggcctgaaaaataagattaatgaacctagtacttataaattaatacatcatcctgatgtttctgtccaatctgtggctgatcaacccaaagtagctattaaacatgtgaaccttgggaatgaaaaccatatgtacttggaagttaagaacagccaatatagttgttcagaaatgaatttggattctggtttcttgggtcagtcaatagtcaatcgacctcaaataactattttggagcaggagcacattgaactagaaggtaagcacaatcaatgttgtggttctgaagtaagttttgattctgatgaccctcttcagtcagtggctgaccggctgagagaaaccgttaaagaaataagcctttggaaggatgaagaagttgacacggaagataggagaaatgaagctaagggttttgaaattatgtatgattctgatgttcttcagccagtggctggccaacctgaagaagtagttaaggaggtcagtctttggaaagagcatgttgacttggaaaataagattgtcaaacctacagattccagaataaattttgattctcatgaaccccttcagtccgtaactaataaaattccaggggcgaataaagaaataaatcttttgagggaggaacatgtttgtctggatgataagggctatgtgcccagtgattctgaaataatttatgtttcaaatatccctcttcagtcagtgataaaacaaccacacattttggaagaggagcatgccagtctggaagataagagcagtaattcttatagtcctgaagaaagttctgattccaatgactcttttcaggcagcagcagatgagcttcaaaaacctgtcaaagaaataaatctttggaaggaagaccatatttacctggaagataagagctataaattaggtgattttgatgtaagttatgcttctcatattcctgttcagtttgtgactgatcaatcttctgtacctgtcaaagaaataaacttgcaaaagaaggatcataatgatctagaaaataagaactgtgaagtctgtggttctgaaataaaatgtcattcttgtgttcatcttcagtcagaagttgaccaacctcaagtgtcttacaaagaggcagaccttcagaaggaagagcatgttgtcatggaagaaaagaccgatcaacctagtgattcagaaatgatgtatgattctgatgttccttttcaaatagtagttaaccaatttccaggatcagtcaaagaaacccaccttccaaaggtggtacttgtggatctggtgcccggtgatagtgattatgaagtaatttcagatgatattccccttcagttagtgactgacccacctcagttgactgtcaaagatatcagctgtataaatacagaatgtattgatatagaagataagagctgtgacttttttggttctgaagtcagatgtaattgtaaagcctctactccctcaatgacaaaccaatgcaaagagactttcaaaataataaaccggaagaaggactatattattctgggagagccaagttgtcaatcttgtggttctgaaatgaattttaatgttgatgcctctgatcagtccatgacttacgagtcacaaggacctgatgagaaaatggtgaaatatattgattcagaagataagagctgtggatataatggttctaaaggaaaatttaatttggaagacacttctcatcgaacgactcaccgactgcagaaagctcacaaagaagccagtcttcggaaggatccaagaaatgctggcctaaaaggtaagagctgtcagtctagtgcttctgcagtggattttggtgcctcttccaagtcagcgctccatcgaagggctgataaaaaaaaacgttcgaagctaaaacatagagatctagaagtgagctgtgaaccggatggttttgagatgaattttcagtgtgctccccctcttccatctgatactgatcagcctcaagaaactgttaagaaaagacacccttgtaagaaggtatcttctgacttgaaagaaaagaaccatgattcccagtcaagctctgttctcaaggttgattctgtaaggaacctgaaaaaagcaaaggatgtcatagaggataatcctgatgaaccagttcttgaagccttgcctcatgtacctccttcatttgtggggaaaacatggtctcagataatgagagaagatgacataaaaattaatgctctggtgaaggagtttagggaaggtcgtttccactgttactttgatgatgactgtgagaccaaaaaagtttcttcgaaggggaaaaaaaaggttacctgggctgacttgcaaggtaaggaggacactgcaccaactcaagctgtgtcagagagtgatgatattgtctgtggtatttcagatattgatgacttgtcagtggccttagataaaccatgccatcgtcatcctccagcagagaggcctcctaagcaaaaggggcgtgtggcttctcaatgccagacagcgaaaatcagccatagtactcagaccagttgtaagaattacccagtgatgaaaagaaaaataattagacaagaggaagacccaccaaaaagtaagtgttcacgtttacaggatgacagaaaaaccaaaaagaaagtcaaaattgggacagttgaatttcctgcatcatgtactaaagttttgaagcctatgcaacccaaagccttagtctgtgttctttcttctttaaatattaaactgaaagagggtgaaggccttcctttccctaaaatgaggcaccatagttgggataatgatattcggtttatatgcaaatataaacggaatatctttgattattatgagcccttgattaagcaaattgtaattagtcctcccctgagtgtaatagtaccagagtttgagaggcgtaactgggttaaaattcattttaataggagcaaccaaaactccagtgcaggagataatgatgctgatggacaaggctctgcttcagcgcctttaatggcagtgccggcaagatatggatttaattcacatcagggaaccagtgactcttctctgtttctggaagaatcaaaggttctgcatgctcgtgagcttccaaagaaaagaaatttccagctaacatttttaaatcatgatgttgtcaaaatctctccaaaatcagttagaaataagcttttggaaagtcaaagtaaaaagaaaattcatggaaagagggtgacaactagtagtaataagctaggttttcccaaaaaggtttataaaccaattattctccagcaaaaacccagaaaagcttcagagaaacagtcaatttggattcggaccaaaccaagtgatatcattagaaagtatatttcgaaatactctgtctttttacgtcatagatatcagtccaggagcgcttttcttggaaggtatctgaagaagaaaaaatctgttgtcagtaggctaaagaaggcgaagagaacagctaaagtgcttttgaactcttcagttccaccagctggtgccgaagagctgtcaagcgctatggcaaatcctcctccaaagcgacctgtgcgggcttcttgccgcgttgcaagaaggaggaagaagactgatgaaagctaccatggccgacagaaaggtccttctacacctgtgagagcatatgatctgagaagctcatcttgtttacaacaacgtgagagaatgatgactcggctagcaaacaaactgagaggtaatgaggtaaaatag

SEQ ID NO: 13906 - DNA, 310 bp, Artificial Sequence
  Synthetic polypeptide
ggccgggcatggtggctgacacctggaataccagcacttggggaggccgagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13907 - DNA, 189 bp, Artificial Sequence
  Synthetic polypeptide
ggccgggcatggtggctgacacctggaataccagcacttggggaggccgagggatggccagtcaggaaagataaccgtggatgactatggagccagaacaggcaaatccccaggcatgatgcggcagcttaacatcaatggagctctgtatgtgggtggaatgaaggaaattgctctgcacactaacag

SEQ ID NO: 13908 - DNA, 158 bp, Artificial Sequence; identical to SEQ ID NO: 7602
  Synthetic polypeptide

SEQ ID NO: 13909 - DNA, 570 bp, Artificial Sequence
  Synthetic polypeptide
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggtccatccaccggtggtgccattgtaaaggccatcggttttccctggctcatggtcatcactggggtcatcaacatcgtctatgctccactctgctactacctgcggagccccccggcaaaggaagagaagcttgctattctgagtcaggactgccccatggagacccggatgtatgcaacccagaagcccacgaaggaatttcctctgggggaggacagtgatgaggagcctgaccatgaggagtag

SEQ ID NO: 13910 - DNA, 411 bp, Artificial Sequence
  Synthetic polypeptide
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtgttcctctggctcacaatatttttggtctcattggccccaatgcagggcttggccttgccataggcatggtggattcttctatgatgcccatcatggggcacctggtggatctacgccacacctcggtgtatgggagtgtctacgccatcgctgatgtggctttttgcatgggctttgctataggctattctgagtcaggactgccccatggagacccggatgtatgcaacccagaagcccacgaaggaatttcctctgggggaggacagtga

SEQ ID NO: 13911 - DNA, 150 bp, Artificial Sequence
  Synthetic polypeptide
ccttgatgtctagctttcttgcctgccagtgtgtcctacctcattggcaccaacctctttggtgtgttggccaacaagatgggtcggtggctgtgttccctaatcgggatgctggtagtaggtaccagcttgctctgtctaccaagttag

SEQ ID NO: 13912 - DNA, 701 bp, Artificial Sequence
  Synthetic polypeptide
ggctacctacaaagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13913 - DNA, 599 bp, Artificial Sequence
  Synthetic polypeptide
ggctacctacaaagatcatcttcttcctgggaaccacggccctggccttcctggtgctcatgcctgtgctccatggcaggaacctcctgctcttccgttccctggagtcctcgtgaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcaca

SEQ ID NO: 13914 - DNA, 4420 bp, Artificial Sequence
  Synthetic polypeptide
cagaatctaaagctagcattaaggaacactgagaaccttcagatttaccctttggaattcccataaattctcagagtttggtaccaagtacttctggaagtagaagataaaagagaagataaagaagactgattgaaagtatgattgagaagtgtcagcattccatatctctttccaatgtctgcatagccaggcaatcccctccctcttcccaaaagactagttaaaagcaaaaggtctgtgaacagggggcatccatcacaattggagatatgggtaccatactgaaaagtatatatacatgggatgcggagacctcagtcttcttccctgctcagttcccctatttaggtcagacttgttcctttaggtaggatattgaaagatcttccctgggatgtgaccagcctaagaagaaaaacataatgatattgatattgaaaactctcaaaacagctacagtaaagttcacagtcaagaatccccactcacacacacaaagtttacaatgagttttttattcatgaacacttaaatatgagcagataatcaaggattcctaagcatctaaacagtgcctctaacatgaaagataaaagccaacaccagaaagtcgaaatatcttggaggaaatagagaccatgaagaaaaatgtaacagaaacacaccaaaaaaacagtattcacttagatccctagacagataaaatactacaactgtaaacatgagcaggatagtatataaaagtaaatgaataataacaaaagggcaaaaagagccttgggattttaataatatgatatcagaaatggaaaactcacttaaggattaaaaggaaatttggagaaatcttttggaaagtagaacaaaaaaataaagagatggcaaaaaggagagaaaagaaaattagtgcctcaattcaggacataaactgtacaaataacaggcattctacaaaggaagaaaagagaaaaaaccaaggagatattaccaataaaatagttcagagatacaaaaagatgaaaatagaccaaagccaggaaatgaaaagaaaatgctacaaaattccagaaagtaaaaacaaaaacaagaaaagtcaagaatcaaaatggctttggacttaccatcaatactggcagcaagaagattgcagggcaattacttcaaaattctgaaggaaaattatttctaacctagaattccatacccagccaaactatcaatgaaggatgatagaagactcttactacatttacctcctttacatcttttctcaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagagtgtgggaactactgcctcaatacgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13915 - DNA, 4396 bp, Artificial Sequence
  Synthetic polypeptide
cagaatctaaagctagcattaaggaacactgagaaccttcagatttaccctttggaattcccataaattctcagagtttggtaccaagtacttctggaagtagaagataaaagagaagataaagaagactgattgaaagtatgattgagaagtgtcagcattccatatctctttccaatgtctgcatagccaggcaatcccctccctcttcccaaaagactagttaaaagcaaaaggtctgtgaacagggggcatccatcacaattggagatatgggtaccatactgaaaagtatatatacatgggatgcggagacctcagtcttcttccctgctcagttcccctatttaggtcagacttgttcctttaggtaggatattgaaagatcttccctgggatgtgaccagcctaagaagaaaaacataatgatattgatattgaaaactctcaaaacagctacagtaaagttcacagtcaagaatccccactcacacacacaaagtttacaatgagttttttattcatgaacacttaaatatgagcagataatcaaggattcctaagcatctaaacagtgcctctaacatgaaagataaaagccaacaccagaaagtcgaaatatcttggaggaaatagagaccatgaagaaaaatgtaacagaaacacaccaaaaaaacagtattcacttagatccctagacagataaaatactacaactgtaaacatgagcaggatagtatataaaagtaaatgaataataacaaaagggcaaaaagagccttgggattttaataatatgatatcagaaatggaaaactcacttaaggattaaaaggaaatttggagaaatcttttggaaagtagaacaaaaaaataaagagatggcaaaaaggagagaaaagaaaattagtgcctcaattcaggacataaactgtacaaataacaggcattctacaaaggaagaaaagagaaaaaaccaaggagatattaccaataaaatagttcagagatacaaaaagatgaaaatagaccaaagccaggaaatgaaaagaaaatgctacaaaattccagaaagtaaaaacaaaaacaagaaaagtcaagaatcaaaatggctttggacttaccatcaatactggcagcaagaagattgcagggcaattacttcaaaattctgaaggaaaattatttctaacctagaattccatacccagccaaactatcaatgaaggatgatagaagactcttactacatttacctcctttacatcttttctcaggaaggtgttggaggatgactgtcacgaaaacttggacagaaccatgacgcaggaccaaagctgcaggaaacagaagatccaatccaggagagggatataagaagtccccagaataatagtgggaaggagatgctagaatgacaaatatttactagatagaaaaggcaaccagtccaactggaacaggcaaggtagggcctcctcttgacatcaagctgggcgcattgaactgtacggctttcagcatccagtggaaaatgccaaggcatcctggaagtcccatccttgggtacactgtcttttactctgaggttggcgcagataaatccctgcaggagcagttgcacagcgtgcctctcagccgggacatcccgaccacggaggaagtgattggagatttgaaaccaggcactgaatatcgtgtgagcatagcagcttacagccaggctggcaaagggcggctgagctctcctcggcatgtcaccactttgtcccaagattcctgcctgcctcctgcagctccccagcagccacatgtcattgtggtttcggattctgaggtggccctgtcttggaaacctggagcgagtgaaggaagcgcccctattcagtactattctgtggaattcatcaggccagatttcgacaagaagtggacctcaatccatgagcggatccagatggactccatggttatcaagggcctcgatccagataccaactaccagtttgccgtgagggcaatgaattcccatggccccagcccccgcagctggcccagtgacatcatccggaccctctgccctgaggaggcgggaagtggccgctatggaccccgttatatcaccgacatgggagctggtgaggatgatgaaggatttgaagacgacttagatttggatatttcctttgaggaggttaaaccacttcctgctaccaaaggagggaataagaaatttttggtggaaagcaagaagatgtctatatctaacccaaagaccatttctaggctcatcccccctacctcagcatctctccctgtgaccacggtggctccccagcccattcccatacagagaaaggggaagaatggtgtggccataatgtcaaggctctttgacatgccttgtgatgaaactctctgctctgctgacagcttctgtgtcaatgactacacctgggggggctcgcgatgccagtgcaccctgggcaaaggtggtgagagctgctcagaagatattgttatccagtatcctcagttctttggccactcctatgtaacgtttgaacctctgaagaattcttatcaggcatttcaaattactcttgaatttagggcggaggcagaggatggcttactgctctactgtggggagaacgaacacgggaggggggatttcatgtccctggctatcatccgacgctccctgcagttcaggtttaattgtggaactggggttgccatcatcgtaagtgagaccaaaatcaaactagggggttggcacacggttatgctctacagagatgggctgaacgggctgctgcagctgaacaatggcaccccagtgacaggccagtctcagggccaatacagtaaaattactttccggacacctctctatcttggtggcgctcccagcgcttactggttggttagagcaacagggacaaaccgaggctttcaaggctgtgtgcagtcgctcgctgtgaatgggaggagaattgacatgaggccctggcccctgggaaaagcactcagtggggctgatgtgggggaatgcagcagtggaatctgtgatgaggcctcgtgcatccatggtggcacctgcacagcaatcaaagccgactcctacatttgcctctgtccccttgggtttaaaggtcgacactgtgaagatgctttcaccttgaccattcctcagttcagagagtctctgagatcttacgctgcaactccctggccactggagccccagcattacctttccttcatggaatttgagatcacatttcggccagactcaggagatggtgtcctcctgtacagctatgacacaggcagcaaagacttcctgtccatcaacttggcagggggccacgtggagttccgctttgactgtggctctgggaccggtgtcctcaggagtgaagatcccctcaccctgggcaactggcacgagcttcgtgtatctcgcacagcaaagaatggaatcttacaggtggataagcagaagatagtggagggaatggcagagggaggcttcacacagattaagtgcaacacagacattttcattggcggagtccccaattatgatgatgtgaagaagaactcgggtgtcctgaagcctttcagcgggagcatccagaagatcatcctgaatgaccgaaccatccatgtgaagcatgacttcacctccggagtgaatgtggagaatgcggcccacccctgtgtgagagccccttgtgcccatgggggcagctgccggcccaggaaggagggctatgactgtgactgccccttgggctttgaggggcttcactgccagaaagcgatcatagaagccattgagatcccgcagtttatcggccgcagttacctgacgtatgacaacccagatatcttgaagagggtgtcaggatcaagatcaaatgtgttcatgaggtttaaaacaactgccaaggatggccttttgctgtggaggggagacagccccatgagacccaacagcgacttcatttccttgggccttcgggatggagccctcgtgttcagctataacctgggcagtggtgtggcatccatcatggtgaatggctccttcaacgatggtcggtggcaccgagttaaggccgttagggatggccagtcaggaaagataaccgtggatgactatggagccagaacaggcaaatccccaggcatgatgcggcagcttaacatcaatggagctctgtatgtgggtggaatgaaggaaattgctctgcacactaacaggcaatatatgagagggctcgtgggctgtatctctcacttcaccctgtccaccgattaccacatttccctcgtggaagatgccgtggatgggaaaaacatcaacacttgtggagccaagtaa

SEQ ID NO: 13916 - DNA, 378 bp, Artificial Sequence
  Synthetic polypeptide
aacaacagaataaaccaaacaaaatagaaaaaaggagataatacaggaatgggaaaaggacagcacaggatgccctccaaggatgagctggtccagagatacaacaggatgaataccatcccccagacccgatccattcagtcacggttcctgcagagtcggaatctaaactgtatagcactttgtgaagtgattacatctaaggacctccagaagcatgggaacatctgggtgtgccctgtgtccgaccatgtctgcacaagattcttctttgtatatgaggatggtcaggtgggcgatgccaacattaatactcaggaccccaagatacagaaggaaatcatgcgtgtgatcggaactcaggtttacacaaactga

SEQ ID NO: 13917 - DNA, 112 bp, Artificial Sequence
  Synthetic polypeptide
aacaacagaataaaccaaacaaaatagaaaaaaggagataatacaggaatgggaaaaggacagcacaggatgccctccaaggatgagctggtccagagatacaacaggatga

SEQ ID NO: 13918 - DNA, 86 bp, Artificial Sequence
  Synthetic polypeptide
aacaacagaataaaccaaacaaaatagaaaaaaggagataatacaggaatgggaaaaggacagcacaggatgccctccaaggatga

SEQ ID NO: 13919 - DNA, 141 bp, Artificial Sequence
  Synthetic polypeptide
aacaacagaataaaccaaacaaaatagaaaaaaggagataatacaggaatgggaaaaggacagcacaggatgccctccaaggatgagctggtccagagatacaacaggatgaataccatcccccagacccgatccattcag

SEQ ID NO: 13920 - DNA, 305 bp, Artificial Sequence
  Synthetic polypeptide
tgttggtgatttgcactggaccccgagctctttgagagcaggcctgcgcttacccactctatccagcaccaagcaatcactcggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctga

SEQ ID NO: 13921 - DNA, 391 bp, Artificial Sequence
  Synthetic polypeptide
tgttggtgatttgcactggaccccgagctctttgagagcaggcctgcgcttacccactctatccagcaccaagcaatcactcggccctgatccttcaccagctaggccgctacagtctggcggagaagatcctccgggacgcggtgcaggtgaactcgacagcccacgaggtctggaacgggctgggcgaggtcctccaagctcagggcaacgatgcggcggctacggagtgcttcctgacagccttggagctggaggccagcagccccgccgtgcccttcaccatcatcccccgcgtgctctgagcaggcgcctgccagcctcacctgccgctcaggcctcagaggccctgccgggcaccagggcttgtgccatcgccccaaggggatga

SEQ ID NO: 13922 - DNA, 756 bp, Artificial Sequence; identical to SEQ ID NO: 8739
  Synthetic polypeptide

SEQ ID NO: 13923 - DNA, 1739 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13924 - DNA, 1874 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13925 - DNA, 1826 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13926 - DNA, 1787 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttag

SEQ ID NO: 13927 - DNA, 398 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtgtga

SEQ ID NO: 13928 - DNA, 278 bp, Artificial Sequence
  Synthetic polypeptide
gggagcagggtgcggagattgagaacgcggacctggcatcagatgactcgagtttcaatcttgtttctaccacttgctaactggctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaag

SEQ ID NO: 13929 - DNA, 1272 bp, Artificial Sequence; identical to SEQ ID NO: 10519
  Synthetic polypeptide

SEQ ID NO: 13930 - DNA, 1572 bp, Artificial Sequence
  Synthetic polypeptide
ccctgctgctaactcactggctgaatttagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaagtccctaagcaaaaaggtgtcaactctgcccgctcagttcctccttcctacccaccaccgcaggacccgttaaaccacggccagtacctggtccccgacggcatcgctcagtcgcaggtctttgagttcaccgaacccaagcgcagccagtcaccattctggcaaaacttcagcaggttaacccccttcaaaaaatga

SEQ ID NO: 13931 - DNA, 1464 bp, Artificial Sequence
  Synthetic polypeptide
ccctgctgctaactcactggctgaatttagctgatcactggagattccatcgttagtgctgaggcagtatgggatcacgtcaccatggccaaccgggagttggcatttaaagctggcgacgtcatcaaagtcttggatgcttccaacaaggattggtggtggggccagatcgacgatgaggagggatggtttcctgccagctttgtgaggctctgggtgaaccaggaggatgaggtggaggaggggcccagcgatgtgcagaacggacacctggaccccaattcagactgcctctgtctggggcggccactacagaaccgggaccagatgcgggccaatgtcatcaatgagataatgagcactgagcgtcactacatcaagcacctcaaggatatttgtgagggctatctgaagcagtgccggaagagaagggacatgttcagtgacgagcaactgaaggtaatctttgggaacattgaagatatctacagatttcagatgggctttgtgagagacctggagaaacagtataacaatgatgacccccacctcagcgagataggaccctgcttcctagagcaccaagatggattctggatatactctgagtattgtaacaaccacctggatgcttgcatggagctctccaaactgatgaaggacagccgctaccagcacttctttgaggcctgtcgcctcttgcagcagatgattgacattgctatcgatggtttccttttgactccagtgcagaagatctgcaagtatcccttacagttggctgagctcctaaagtatactgcccaagaccacagtgactacaggtatgtggcagctgctttggctgtcatgagaaatgtgactcagcagatcaacgaacgcaagcgacgtttagagaatattgacaagattgctcagtggcaggcttctgtcctagactgggagggcgaggacatcctagacaggagctcggagctgatctacactggggagatggcctggatctaccagccctacggccgcaaccagcagcgggtcttcttcctgtttgaccaccagatggtcctctgcaagaaggacctaatccggagagacatcctgtactacaaaggccgcattgacatggataaatatgaggtagttgacattgaggatggcagagatgatgacttcaatgtcagcatgaagaatgcctttaagcttcacaacaaggagactgaggagatacatctgttctttgccaagaagctggaggaaaaaatacgctggctcagggctttcagagaagagaggaaaatggtacaggaagatgaaaaaattggctttgaaatttctgaaaaccagaagaggcaggctgcaatgactgtgagaaaactcccttttcctcaactcagtgaggccaggatttgctctccaaaaggctttgctagtgtgttcaatgggacctgctgtggggagtcctaa

SEQ ID NO: 13932 - DNA, 788 bp, Artificial Sequence
  Synthetic polypeptide
ccatcttatcccaaaagtcttatctttctccgttgcgttcatctccacaggccatacagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13933 - DNA, 149 bp, Artificial Sequence
  Synthetic polypeptide
ccatcttatcccaaaagtcttatctttctccgttgcgttcatctccacaggccatacagatggttgccaccctggggaccacaacatgctgctcctttgacaatctcttagaagtcggtcctatcttttgcagattcattcaactttaa

SEQ ID NO: 13934 - DNA, 362 bp, Artificial Sequence
  Synthetic polypeptide
ccatcttatcccaaaagtcttatctttctccgttgcgttcatctccacaggccatacagatggttgccaccctggggaccacaacatgctgctcctttgacaatctcttagaagtcggtcctatctgcaacaaggaagacatatggctgcacgttgatgcagcctacgcaggcagtgcattcatctgccctgagttccggcaccttctgaatggagtggagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttga

SEQ ID NO: 13935 - DNA, 1117 bp, Artificial Sequence
  Synthetic polypeptide
aggcagccatgtgtcagtgcaaagagatcccgagcttgtcatttggaggcttgggttccaggctcagctctgctgcccgcaaactgtgagatggacagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctga

SEQ ID NO: 13936 - DNA, 611 bp, Artificial Sequence; identical to SEQ ID NO: 9528
  Synthetic polypeptide

SEQ ID NO: 13937 - DNA, 578 bp, Artificial Sequence; identical to SEQ ID NO: 9529
  Synthetic polypeptide

SEQ ID NO: 13938 - DNA, 293 bp, Artificial Sequence; identical to SEQ ID NO: 9530
  Synthetic polypeptide

SEQ ID NO: 13939 - DNA, 2142 bp, Artificial Sequence
  Synthetic polypeptide
ggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacaggctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtga

SEQ ID NO: 13940 - DNA, 726 bp, Artificial Sequence
  Synthetic polypeptide
ggccaggcatggtggctcacgcctgtaatcctagtgctttgggaggccgaggcaggtggattacgaggtcaggagatcgagaccatcctggccaacatggtgaaaccacgtctcttctaaaaatacaaaaattagccgggcgtggtggcgcacacctatagtcccagctaatccagaggctggggcaggagaattgcttgaacctgggaggtggaggttgcagtgagccgagatcacactactgcactccagcctggtgacaggctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatga

SEQ ID NO: 13941 - DNA, 512 bp, Artificial Sequence
  Synthetic polypeptide
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcacttgctggtctcttgggatttggccttggaaaggtatcatacataggagtatgccagagtaaattccatttttttgaagatcagctccgtggggctggttttggtccacagcataacaggcactgcctccttacctgtgaggaatgcaaaataaagcatggattaagtgagaagggagactctcagccttcagcttcctaa

SEQ ID NO: 13942 - DNA, 347 bp, Artificial Sequence
  Synthetic polypeptide
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcacgcactgcctccttacctgtgaggaatgcaaaataa

SEQ ID NO: 13943 - DNA, 312 bp, Artificial Sequence
  Synthetic polypeptide
tgtggtgtgaatgtctccttcaaaactcagggtgaaatttaactgccattgtaacagtatcaagaggtggggcctttaagaggttaagttatgagggctccaccctcgtgaattgattactaccattatcatgggagtgagttccttataaaaaggatgtgttcagcctctcctcttgctctctgtttcatgcacttccttgccatgggataaccctcactacatgccagctctgtgctcttggacttctcagcctccagaactgttatttggcagctaattctagatttggatcattgcccaaagttgcac

SEQ ID NO: 13944 - DNA, 819 bp, Artificial Sequence
  Synthetic polypeptide
cccagattagctcctggcttgaacttgtaccacccttacctgaaaattggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13945 - DNA, 239 bp, Artificial Sequence
  Synthetic polypeptide
cccagattagctcctggcttgaacttgtaccacccttacctgaaaattggcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13946 - DNA, 739 bp, Artificial Sequence
  Synthetic polypeptide
ggccaggcgcggtggctcatgcctgtaatcccagcactttgggaggccaaggcgggtggatcacttgaggtcaagagttcaagaccagcctaaccaacatgtgccctacaagttcttcccagagccatccggcctgcacgagaagcgcaagcagcggcgcatccgcaccacgttcaccagcgcgcagctcaaggagctggagcgcgttttcgctgagacccactaccccgacatttacacgcgtgaggagctggcgctcaagatcgacctcactgaggctcgcgtgcaggtctggttccagaaccgccgggccaagttccgcaaacaggagcgcgcggccagcgccaagggcgcggcgggcgcggcgggcgccaaaaagggcgaggcgcgctgctcctccgaggacgacgattccaaggagtccacgtgcagccccacgcccgatagcaccgcctcgctgccgccgccgcctgcgcccggcctggccagcccgcgcctgagccccagcccgctgcccgtcgcactgggctccgggccgggacctgggccggggccacagccgctcaagggcgcactgtgggccggtgtggcgggcggtgggggcggcgggcctggcgcgggagcggccgaactacttaaggcttggcagccggcggagtccggccccgggcccttctccggggttctgtcctcctttcaccggaagcccggccccgccctgaagaccaatctcttctag

SEQ ID NO: 13947 - DNA, 319 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 13948 - DNA, 310 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 13949 - DNA, 3565 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactga

SEQ ID NO: 13950 - DNA, 3544 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 13951 - DNA, 224 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 13952 - DNA, 159 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgct

SEQ ID NO: 13953 - DNA, 3508 bp, Artificial Sequence
  Synthetic polypeptide
gtgatgactccagactttctatagagcaggggctttgggccaccaatctgttcagaatggctgggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatga

SEQ ID NO: 13954 - DNA, 1553 bp, Artificial Sequence
  Synthetic polypeptide
gcagaggaaggaatgaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 13955 - DNA, 448 bp, Artificial Sequence
  Synthetic polypeptide
gcagaggaaggaatgaggaggaggagggagagaactatcaaaaaggggagcgaggggaagatagcagtgaagagaaacaccttgaagagccaggagagacacaaaacgcttttctcaatgaaagaaagcaggcttcagctataaaaaaagaggagttagtggccagatcggaaacacatgctgccgggcattctcaggagaagacacatagccgagagaagagtagccaggagagtggagaggagacagggagccaggagaatcacccccaggagtctaaaggccaaccccgaagccaggaagaatctgaggaaggtgaggaagatgccacctctgaggtggacaaacgacgcacgaggcccagacaccaccacgggaggagcaggcccgacaggtcctctcaaggagggagtcttccctctgaggaaaagggacacccccaggagga

SEQ ID NO: 13956 - DNA, 244 bp, Artificial Sequence
  Synthetic polypeptide
ggccgggcacagtggctcgtacctgcaatcccagcactttggaagggcaaagcgggtggatcacttgagcccaggagttaaagaccagcctgggcaacacaggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctga

SEQ ID NO: 13957 - DNA, 204 bp, Artificial Sequence
  Synthetic polypeptide
gcccggggggacccacgcgtgacccgggccaagtacttcattcgagatgagtttctgaggatcagcactgccagtggagatgggcgtcactactgctaccctcatttcacctgcgctgtggacactgagaacatccgccgtgtgttcaacgactgccgtgacatcattcagcgcatgcaccttcgtcagtacgagctgctctaa

SEQ ID NO: 13958 - DNA, 1900 bp, Artificial Sequence
  Synthetic polypeptide
taagagcctggagctggacagacttgctttcacccccagttttgcaacttgctaaccagctgcatgatcttactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctag

SEQ ID NO: 13959 - DNA, 139 bp, Artificial Sequence
  Synthetic polypeptide
gggctttggagtcgggctgctgggttctgttctgtcttctagccgccggtgtggctgggtcatgttgcttaacttatgggtctgctttctcatctctaaagctggagccagacatcctgcttcgggccaagcaagattt

SEQ ID NO: 13960 - DNA, 2225 bp, Artificial Sequence
  Synthetic polypeptide
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 13961 - DNA, 200 bp, Artificial Sequence
  Synthetic polypeptide
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggt

SEQ ID NO: 13962 - DNA, 2258 bp, Artificial Sequence
  Synthetic polypeptide
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcatgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtcagagcccagcaggcagccaggcgggcgggcgagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatga

SEQ ID NO: 13963 - DNA, 269 bp, Artificial Sequence
  Synthetic polypeptide
gggctttggagtcgggctgctgggttctgttctgtcttctagccgccggtgtggctgggtcatgttgcttaacttatgggtctgctttctcatctctaaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggag

SEQ ID NO: 13964 - DNA, 1058 bp, Artificial Sequence
  Synthetic polypeptide
attctggagttcagccatctgggcttgatttcctcctctcctgtattcatcacatgaactaggtgagttgctgcactgctcccaggactcagttttctcatctgtaaaatggaggcaatctggacggaacaaggaggctgtaagaatccagcaagggcaagaatggatcaccgggatctccaggagagcctggcccttcaggaacccctggccagaaaggaagcaaaggggaaaatggcagcccaggacttcctggcttcctgggtccccgtgggcctccgggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagggcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctggccctcaaggggagacaggaccagctggacatcctggcctcccaggacctcccggtcccccaggccaatgtgacccttcccagtgtgcctacttcgccagccttgctgcccggccgggtaatgtgaagggtccctaa

SEQ ID NO: 13965 - DNA, 456 bp, Artificial Sequence; identical to SEQ ID NO: 9037
  Synthetic polypeptide

SEQ ID NO: 13966 - DNA, 162 bp, Artificial Sequence
  Synthetic polypeptide
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgt

SEQ ID NO: 13967 - DNA, 1023 bp, Artificial Sequence
  Synthetic polypeptide
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccagcggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaa

SEQ ID NO: 13968 - DNA, 804 bp, Artificial Sequence
  Synthetic polypeptide
ccctagcccctaccacctcctcccagtctcctgttgctggtgttcctcacttcctcattcctgcacactccgtgccctgtattctaaagatctgtttataaatttcctgtgggtaccgaatgcctcctcagagatgttcgggcctgctcctcggccccctgtgccaacaacaggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacattgggggcgacttccgctgccggtgcccagccggcttcatcgacaagacctgcagccgcccggtgaccaactgcgccagcagcccgtgccagaacgggggcacctgcctgcagcacacccagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaa

SEQ ID NO: 13969 - DNA, 732 bp, Artificial Sequence
  Synthetic polypeptide
gtggtggctcacacctgtaatcccagcactttgggaagctgaggtaggaggatcgcctgaagtcaggaattcaagatcagcctggacaacatggtgaagctccgtctctactaaaaatacaaaaattagccaggcatggtggcacgtacctgtagtcccagcaactcaggaggtgaaggcaggagaatagtttgaagcggggaggcagaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgccccccgcccccgctcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtga

SEQ ID NO: 13970 - DNA, 626 bp, Artificial Sequence
  Synthetic polypeptide
ccatcttatcccaaaagtcttatctttctccgttgcgttcatctccacaggccatacagtttgcagattcattcaactttaatccccacaaatggctattggtgaattttgactgttctgccatgtgggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13971 - DNA, 82 bp, Artificial Sequence
  Synthetic polypeptide
ccatcttatcccaaaagtcttatctttctccgttgcgttcatctccacaggccatacagtttgcagattcattcaactttaa

SEQ ID NO: 13972 - DNA, 200 bp, Artificial Sequence
  Synthetic polypeptide
ccatcttatcccaaaagtcttatctttctccgttgcgttcatctccacaggccatacagtttgcagattcattcaactttaatccccacaaatggctattggtgaattttgactgttctgccatgtggtccagacaaccagtgcgtatgttaaggctgaagaaaacctgcttagtcagtgcggtggtgagaaggagttga

SEQ ID NO: 13973 - DNA, 1163 bp, Artificial Sequence
  Synthetic polypeptide
gactgggcacggtggttcacccctgtaatcccagcactttgagaggccgaggcacgtggatcacttgagacttttcccttgttttattgataaaaggaggggccctctctggaacagatacctaccagtctttggtcaataaaactttcggctttccagggtatctgctcctctctgttcttcagtttttgtatccttttatagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatga

SEQ ID NO: 13974 - DNA, 1229 bp, Artificial Sequence
  Synthetic polypeptide
gactgggcacggtggttcacccctgtaatcccagcactttgagaggccgaggcacgtggatcacttgagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatga

SEQ ID NO: 13975 - DNA, 922 bp, Artificial Sequence
  Synthetic polypeptide
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13976 - DNA, 342 bp, Artificial Sequence
  Synthetic polypeptide
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13977 - DNA, 646 bp, Artificial Sequence; identical to SEQ ID NO: 7772
  Synthetic polypeptide

SEQ ID NO: 13978 - DNA, 304 bp, Artificial Sequence; identical to SEQ ID NO: 7773
  Synthetic polypeptide

SEQ ID NO: 13979 - DNA, 619 bp, Artificial Sequence; identical to SEQ ID NO: 7774
  Synthetic polypeptide

SEQ ID NO: 13980 - DNA, 523 bp, Artificial Sequence; identical to SEQ ID NO: 7775
  Synthetic polypeptide

SEQ ID NO: 13981 - DNA, 441 bp, Artificial Sequence; identical to SEQ ID NO: 7776
  Synthetic polypeptide

SEQ ID NO: 13982 - DNA, 167 bp, Artificial Sequence; identical to SEQ ID NO: 7777
  Synthetic polypeptide

SEQ ID NO: 13983 - DNA, 985 bp, Artificial Sequence
  Synthetic polypeptide
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcaggttagaaaatggaataaatgatcctgcttctataaaaggatgcatatgtgttttaggaagaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcataggcctgatcttcctgcagggaaatgccctgctggtttaccgtgtcttcaggaacgaagctaaacgcaccaccaaggtcctgcacgggctgctgcacatctttgcgctcgtcatcgccctggttggcttggtggcggtgttcgactaccacaggaagaagggctacgctgacctgtacagcctacacagctggtgcgggatccttgtctttgtcctgtactttgtgcagtggctggtgggcttcagcttcttcctgttccccggagcttcattctccctgcggagccgctaccgcccacagcacatcttctttggtgctaccatcttcctcctttccgtgggcaccgccctgctgggcctgaaggaggcactgctgttcaacctcgggggcaagtatagcgcatttgagcccgagggtgtcctggccaacgtgctgggcctgctgctggcctgcttcggtggggcggtgctctacatcttgacccgggccgactggaagcggccttcccaggcggaagagcaggccctctccatggacttcaagacgctgacggagggagatagccccggctcccagtga

SEQ ID NO: 13984 - DNA, 405 bp, Artificial Sequence
  Synthetic polypeptide
aaatcgaaagctagctaaatgctgaacaatgggaactagttggctaaaaaatggccgtgcaatgcaagagtgtgaggttacgaaaatgatgatgtgggcgcgtatccattgacacaaacatccatgtgtgctacgccctcagttaaaaagcaggttagaaaatggaataaatgatcctgcttctataaaaggatgcatatgtgttttaggaagaagcgtttgcctcagcatggagggcggggccgcggcagccacccccacagcactgccttactacgtggccttctcccagctgctgggcctgaccttggtggccatgaccggcgcgtggctcgggctgtaccgaggcggcattgcctgggagagcgacctgcagttcaacgcgcaccccctctgcatggtcat

SEQ ID NO: 13985 - DNA, 1251 bp, Artificial Sequence
  Synthetic polypeptide
gatcatggttttattctccttaaatctctttgatactttcccactgtctttagcataaatctcagatcctaacaccacccacaacgcttttcaatacctggcttcttgtgatgtctccagtctaatcttttaccctccttcccctcagcctctctgctttagtgaactttgttctagtttcttgaagaagttcatcaattcaagcttttgtgcatggtatttcctaaacctgaaatgtgcttcccccgttttgcccaaacagacacagagtctccactccgccccctggttcacacctgcttaacctgccaagtcacatctgaactgtcacccttcagaaggtcctcctctggcaccctaatgtaattgagatcatcctattactctgtgttctggaactccacacttcagacatttctcattcctgtctaagctcttgtgtgtttggtttttggcctcacttttactgctctttaagctcccccagcggagtggagaggtctgttttcccgtgtttggattcccagaggcagtgcaagcctggcacaagcacgtttcttgcagcaggataagtatgagtgtcatttcttcaacgggacggagcgggtgcggttcctgcacagagacatctataaccaagaggaggacttgcgcttcgacagcgacgtgggggagtaccgggcggtgacggagctggggcggcctgacgctgagtactggaacagccagaaggacttcctggaagacaggcgcgccgcggtggacacctactgcagacacaactacggggttggtgagagcttcacagtgcagcggcgagttgagcctaaggtgactgtgtatcctgcaaggacccagaccctgcagcaccacaacctcctggtctgctctgtgaatggtttctatccaggcagcattgaagtcaggtggttccggaacagccaggaagagaaggctggggtggtgtccacaggcctgattcagaatggagactggaccttccagaccctggtgatgctggaaacagttcctcgaagtggagaggtttacacctgccaagtggagcacccaagcgtgacgagccctctcacagtggaatggagagcacagtctgaatctgcacagagcaagatgctgagtggagtcgggggctttgtgctgggcctgctcttccttggggccgggctattcatctacttcaagaatcagaaagggcactctggacttcacccaacaggactcgtgagctga

SEQ ID NO: 13986 - DNA, 343 bp, Artificial Sequence; identical to SEQ ID NO: 891
  Synthetic polypeptide

SEQ ID NO: 13987 - DNA, 599 bp, Artificial Sequence; identical to SEQ ID NO: 10783
  Synthetic polypeptide

SEQ ID NO: 13988 - DNA, 82 bp, Artificial Sequence; identical to SEQ ID NO: 10784
  Synthetic polypeptide

SEQ ID NO: 13989 - DNA, 1951 bp, Artificial Sequence
  Synthetic polypeptide
tttgccaaaaatggctgcaagaatgtttctggttctatgtgatgtaccagaacttgcactttcttcatcaagaagtcaagtctctgtctcctgctcgtgagactagtcaggcttttgtgactgcctcagctattagattatggcagaagtaatgctgtgtgacttctcagccaaagtcctaagagcagaacagcttctgcctggatctctcactctagctatcatgaagcttctctattacatggagatagagatctgctgaaggagccccagctgttggtattttccaggccaggcaccagtcatatgagtaagccagccatcagacaacttagccccagccactgtctgcctgcaactgcacaagagagctgagtgaaaacaatcttgctgagttcagtcaagctccagaaatgtacggggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtacctagtagatgaaatcaagaaaagagaaggattcaagttactgatggaacctgaatatgccaatatttgcttttggtacattccaccgagcctcagagagatggaagaaggacccgagttctgggcaaaacttaatttggtggccccagccattaaggagaggatgatgaagaagggaagcttgatgctgggctaccagccgcaccggggaaaggtcaacttcttccgccaggtggtgatcagccctcaagtgagccgggaggacatggacttcctcctggatgagatagacttactgggtaaagacatgtag

SEQ ID NO: 13990 - DNA, 1642 bp, Artificial Sequence
  Synthetic polypeptide
tttgccaaaaatggctgcaagaatgtttctggttctatgtgatgtaccagaacttgcactttcttcatcaagaagtcaagtctctgtctcctgctcgtgagactagtcaggcttttgtgactgcctcagctattagattatggcagaagtaatgctgtgtgacttctcagccaaagtcctaagagcagaacagcttctgcctggatctctcactctagctatcatgaagcttctctattacatggagatagagatctgctgaaggagccccagctgttggtattttccaggccaggcaccagtcatatgagtaagccagccatcagacaacttagccccagccactgtctgcctgcaactgcacaagagagctgagtgaaaacaatcttgctgagttcagtcaagctccagaaatgtacggggagatattgatcaacaagagatgattccaagtaagaagaatgctgttcttgtggatggggttgtgctgaatggtcctacaacagatgcaaaagctggagaaaaatttgttgaagaggcctgtaggctaataatggaagaggtggttttgaaagctacagatgtcaatgagaaggtgtgtgaatggaggcctcctgaacaactgaaacagcttcttgatttggagatgagagactcaggcgagccaccccataaactattggaactctgtcgggatgtcatacactacagtgtcaaaactaaccacccaagatttttcaaccaattgtatgctggacttgattattactccttggtggcccgatttatgaccgaagcattgaatccaagtgtttatacgtatgaggtgtccccagtgtttctgttagtggaagaagcggttctgaagaaaatgattgaatttattggctggaaagaaggggatggaatatttaacccaggtggctcagtgtccaatatgtatgcaatgaatttagctagatacaaatattgtcctgatattaaggaaaaggggctgtctggttcgccaagattaatccttttcacatctgcagagtgtcattactctatgaagaaggcagcctcttttcttgggattggcactgagaatgtttgctttgtggaaacagatggaagaggtaaaatgatacctgaggaactggagaagcaagtctggcaagccagaaaagagggggcagcaccgtttcttgtctgtgccacttctggtacaactgtgttgggagcttttgaccctctggatgaaatagcagacatctgcgagaggcacagcctctggcttcatgtagatgcttcttggggtggctcagctttgatgtcgaggaagcaccgcaagcttctgcatggcatccacagggctgactctgtggcctggaacccacacaagatgctgatggctgggatccagtgctgtgctctccttgtgaaagacaaatctgatcttcttaaaaaatgctactctgccaaggcatcttacctcttccagcaggataaattctatgatgtgagctatgacacaggagacaagtctatccagtgtagcagaagaccagatgcattcaagttctggatgacctggaaggccctgggtacattaggccttgaagaaagagttaatcgtgctcttgctttatctaggtactag

SEQ ID NO: 13991 - DNA, 558 bp, Artificial Sequence
  Synthetic polypeptide
ccatcttatcccaaaagtcttatctttctccgttgcgttcatctccacaggccatacagggtgaaaaagagaacagacttaacgggagcctttagactggaccccacttacctgaagcacagccatcaggattcagggcttatcactgactaccggcattggcagataccactgggcagaagatttcgctctttgaaaatgtggtttgtatttaggatgtatggagtcaaaggactgcaggcttatatccgcaagcatgtccagctgtcccatgagtttgagtcactggtgcgccaggatccccgctttgaaatctgtgtggaagtcattctggggcttgtctgctttcggctaaagggttccaacaaagtgaatgaagctcttctgcaaagaataaacagtgccaaaaaaatccacttggttccatgtcacctcagggacaagtttgtcctgcgctttgccatctgttctcgcacggtggaatctgcccatgtgcagcgggcctgggaacacatcaaagagctggcggccgacgtgctgcgagcagagagggagtag

SEQ ID NO: 13992 - DNA, 1946 bp, Artificial Sequence; identical to SEQ ID NO: 10199
  Synthetic polypeptide

SEQ ID NO: 13993 - DNA, 2084 bp, Artificial Sequence; identical to SEQ ID NO: 10200
  Synthetic polypeptide

SEQ ID NO: 13994 - DNA, 1991 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13995 - DNA, 1964 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13996 - DNA, 1967 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagctaccacacctccaagcatggcttcctgtcctgggcccgcgtctgcttgagacactgcatctacactccacagccaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttgggctcctggtgcagcagatcatcttcttcctgggaaccacggccctggccttcctggtgctcatgcctgtgctccatggcaggaacctcctgctcttccgttccctggagtcctcgtggcccttctggctgactttggccctggctgtgatcctgcagaacatggcagcccattgggtcttcctggagactcatgatggacacccacagctgaccaaccggcgagtgctctatgcagccacctttcttctcttccccctcaatgtgctggtgggtgccatggtggccacctggcgagtgctcctctctgccctctacaacgccatccaccttggccagatggacctcagcctgctgccaccgagagccgccactctcgaccccggctactacacgtaccgaaacttcttgaagattgaagtcagccagtcgcatccagccatgacagccttctgctccctgctcctgcaagcgcagagcctcctacccaggaccatggcagccccccaggacagcctcagaccaggggaggaagacgaagggatgcagctgctacagacaaaggactccatggccaagggagctaggcccggggccagccgcggcagggctcgctggggtctggcctacacgctgctgcacaacccaaccctgcaggtcttccgcaagacggccctgttgggtgccaatggtgcccagccctga

SEQ ID NO: 13997 - DNA, 1421 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggggcctggaagatactgggactgttctattatgctgccctctactaccctctggctgcctgtgccacggctggccacacagctgcacacctgctcggcagcacgctgtcctgggcccaccttggggtccaggtctggcagagggcagagtgtccccaggtgcccaagatctacaagtactactccctgctggcctccctgcctctcctgctgggcctcggattcctgagcctttggtaccctgtgcagctggtgagaagcttcagccgtaggacaggagcaggctccaaggggctgcagagcagctactctgaggaatatctgaggaacctcctttgcaggaagaagctgggaagcagaatggctgcagtggaggactggctcctgctccccagaatccttgtcatcaagagggacaactaccagcttgggacagcgggaagaccctggcctggccttggtcatttagggtcctgctggcccttttcctgggccccttgggagggaggagggctcccgggcctgagtggtgctgttcaccatactccttcctttgaggactacaggattccatctcccgctgaagctggtgctttcagctacactgacagggacggccatttaccaggtggccctgctgctgctggtgggcgtggtacccactatccagaaggtgagggcaggggtcaccacggatgtctcctacctgctggccggctttggaatcgtgctctccgaggacaagcaggaggtggtggagctggtgaagcaccatctgtgggctctggaagtgtgctacatctcagccttggtcttgtcctgcttactcaccttcctggtcctgatgcgctcactggtgacacacaggaccaaccttcgagctctgcaccgaggagctgccctggacttgagtcccttgcatcggagtccccatccctcccgccaagccatattctgttggatgagcttcagtgcctaccagacagcctttatctgccttggtga

SEQ ID NO: 13998 - DNA, 467 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccagccctgtggatttcttggctggggacaggccccgggcagtgcctgctgctgttttcatggtcctcctgagctccctgtgtttgctgctccccgacgaggacgcattgcccttcctgactctcgcctcagcacccagccaagatgggaaaactgaggctccaagaggtaacttgcccaagatcacagagttgagactagtcagagcctggatttga

SEQ ID NO: 13999 - DNA, 253 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcaatccttgtgctgctgctcctggccatgctggtgaggcgccgccagctctggcctgactgtgtgcgtggcaggcccggcctgcccag

SEQ ID NO: 14000 - DNA, 251 bp, Artificial Sequence
  Synthetic polypeptide
gccgggcacagtggctcacacctgtaatcccagcactttgggaggctgaggcatgaggattgcttgagctcagaaatccaagaccagcctgggcgacatgggaagtgccctcctgccacaccagcataccacccggcctgtaccacgcctgcctggcctcgctgtcagtgagtccaacccaagttgaacctggcttgcaagctgctgccagcctgggcagtgggacctgtgttccccactggggctggtga

SEQ ID NO: 14001 - DNA, 1386 bp, Artificial Sequence
  Synthetic polypeptide
ggccgggcttggtggcttacacctgtaatcccaacactttgggaggctgagacgggtggatcacctaaggtcaggagttcatgaccagcctgaccaacatggcaaaaccctgtctctacttaaaatacaaaaattagtcgggcatggtggcttgcacctgtagtcctggctatccgggaggctgaggcaggagaattgcttgagcccgggaggaggaggcccgacaggtcctctcaaggagggagtcttccctctgaggaaaagggacacccccaggaggaatctgaggagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14002 - DNA, 281 bp, Artificial Sequence
  Synthetic polypeptide
ggccgggcttggtggcttacacctgtaatcccaacactttgggaggctgagacgggtggatcacctaaggtcaggagttcatgaccagcctgaccaacatggcaaaaccctgtctctacttaaaatacaaaaattagtcgggcatggtggcttgcacctgtagtcctggctatccgggaggctgaggcaggagaattgcttgagcccgggaggaggaggcccgacaggtcctctcaaggagggagtcttccctctgaggaaaagggacacccccaggagga

SEQ ID NO: 14003 - DNA, 1148 bp, Artificial Sequence
  Synthetic polypeptide
gccattggcttgctctgcagccatgggtgagccactctgtctctgaacctcagctttctcatctaagaattggctatccaattcccatatttgcgggattctgcatcatgtttgtctcaacaattatgtttgccttctccagcagctatgccttcctgctgattgccaggtcgctgcagggcatcggctcgtcctgctcctctgtggctgggatgggcatgcttgccagtgtctacacagatgatgaagagagaggcaacgtcatgggaatcgccttgggaggcctggccatgggggtcttagtgggcccccccttcgggagtgtgctctatgagtttgtggggaagacggctccgttcctggtgctggccgccctggtactcttggatggagctattcagctctttgtgctccagccgtcccgggtgcagccagagagtcagaaggggacacccctaaccacgctgctgaaggacccgtacatcctcattgctgcaggctccatctgctttgcaaacatgggcatcgccatgctggagccagccctgcccatctggatgatggagaccatgtgttcccgaaagtggcagctgggcgttgccttcttgccagctagtatctcttatctcattggaaccaatatttttgggatacttgcacacaaaatggggaggtggctttgtgctcttctgggaatgataattgttggagtcagcattttatgtattccatttgcaaaaaacatttatggactcatagctccgaactttggagttggttttgcaattggaatggtggattcgtcaatgatgcctatcatgggctacctcgtagacctgcggcacgtgtccgtctatgggagtgtgtacgccattgcggatgtggcattttgtatggggtatgctataggtccttctgctggtggtgctattgcaaaggcaattggatttccatggctcatgacaattattgggataattgatattctttttgcccctctctgcttttttcttcgaagtccacctgccaaagaagaaaaaatggctattctcatggatcacaactgccctattaaaacaaaaatgtacactcagaataatatccagtcatatccgataggtgaagatgaagaatctgaaagtgactga

SEQ ID NO: 14004 - DNA, 1443 bp, Artificial Sequence
  Synthetic polypeptide
tctcacactaatcccttctgctctcctcctggccttgtcactgttctccaggcaccctaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtga

SEQ ID NO: 14005 - DNA, 1416 bp, Artificial Sequence
  Synthetic polypeptide
tctcacactaatcccttctgctctcctcctggccttgtcactgttctccaggcaccctaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggatccacacacatcctcaccccacagaaactgctggacacactgaagaaactgaataaaacagatgaagaaataagcagttaa

SEQ ID NO: 14006 - DNA, 1040 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacagtatgtagtgacttaattactattcatatatctctcctttag

SEQ ID NO: 14007 - DNA, 2951 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagaagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgctggaggaggaagattatccaggagctattcagttgtgccttgaatgtcaaaaagctgccagcacttttaaacattacagttgtataagtgaactgaattcaaagctgcaagatactttggaacagattgaggaacagctggacgtagctctttccaaaatctgcaagaattttgacattaaccattataccaaggttcaacaagcttatcgacttcttggaaaaacacagacagcaatggatcaacttcatatgcacttcacccaagccattcacaacaccgtgtttcaagttgttcttggttatgtggaactatgtgcaggaaacacagacacaaaattccaaaagctgcaatataaggatctctgtacacatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataa

SEQ ID NO: 14008 - DNA, 170 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaagttagagccctaa

SEQ ID NO: 14009 - DNA, 176 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggtattgagctacacgtaa

SEQ ID NO: 14010 - DNA, 624 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggaagaattcagggaacttcgagaacagccaagtgaccctcaagctgaacaagagcttattaatagtattgaacaagtatatttttctgtggattcatttgatattgttaaatatgagctggagcttccacctgttctcaatttgcaagaattagaggcgtatagagacaaattgaaacaacagcaagctgcagtatctaaaaaagtggcagatttaatccttgaaaaacagcctgcttatgtaaaggaacttgaaagagttacctcattgcagacaggtcttcaattagctgctgttatctgtacaaatgggagaagacacttgaatattgcaaaggaaggttttactcaagctagtttaggccttcttgcaaatcaaaggaaacgtcagttgctgattggacttctgaaatctctgagaactataaaaacattgcaaagaacagatgtacggttaagtgaaatgc

SEQ ID NO: 14011 - DNA, 176 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaaggtattgagctacacgtga

SEQ ID NO: 14012 - DNA, 2111 bp, Artificial Sequence
  Synthetic polypeptide
tgtcagagacattcgaaccagagtgactccattttgaatgagggctacgaaaatgaggctgagacttgctgggctgccttctcagaaagggtctgaaaagccctcaagaaagcctcagtgatcttggtgccatagagagtctccgggtccctggaaagcatgttacaccagacagctatattccatgccttgcagacctgtgcaaagcactatgggaagttatgctcagctattataggactatggaatggcatgaaaagcatgacaatgaggatactgcttcagcttctgaagggagtaatatgataggtactgaagaaactaattttgatcgtggctacataaaaaagaaattagaacatggacttacacgaatatggcaggatgttcagctaaaagtaaaaacctacttgcttggaactgatttgtctatattcaaatatgatgatttcatctttgttttggatataatcagcaggttgatgcaagttggagaagaattttgtggtagcaagtctgaagttttacaggaatctattagaaaacaaagtgtcaattatttcaagaattaccatagaacacggctcgatgaactgagaatgttcttagagaatgagacttgggaactttgtcctgttaagtcaaatttcagcatcttgcaacttcatgaatttaaattcatggaacagtctcgctccccatcagtttcacctagtaaacagccagtctcaacttcttcaaaaacagtgaccttgtttgagcagtactgtagtggtgggaatccatttgaaattcaggccaaccacaaagatgaagaaacagaagatgtcttagcttctaatgggtatgaatctgatgaacaagaaaagagtgcctatcaagagtatgacagtgacagtgatgttcctgaggaactcaaacgagactatgtggatgagcagacaggagatggtcctgtgaaaagtgtttctcgggaaactctaaaaagcaggaagaaatcagattacagtctaaataaagtgaatgcacctatcttaacaaatacaacattgaacgtcataagacttgttggaaaatatatgcagatgatgaacattcttaagccaattgcctttgatgttattcatttcatgtctcaactatttgattattacttgtatgcaatatataccttttttggtcggaatgattcattggaatcaactggactcggccttagtagtagtagactaagaacaactctaaacagaatacaagaaagccttattgatctagaagtttcagctgatcctactgccacactcacagcagcagaagaaagaaaggagaaggtgccaagtccacacctcagtcacctagtggttttgacatctggggatacgctgtatgggttggcagaaagagtggtagccacggaatccttggtattcttggctgaacagtttgagttccttcagccacatctggatgctgtgatgcctgcagtcaaaaagccctttcttcagcagttctattctcagacagtctcaaccgccagtgaactacggaaaccaatttactggattgtagctggtaaagcccttgattatgaacagatgctgcttctcatggctaatgtgaaatgggatgtaaaagaaattatgtcacagcacaacatatatgtagatgcactattaaaggaatttgagcagtttaacaggaggctaaatgaagtttctaagagagttcgcatacccttgcctgtgtctaatatactttgggaacattgtatacgattggctaatcgaactattgtagaaggatatgccaatgtcaagaaatgcagtaatgagggtcgtgccctgatgcaattggattttcaacagtttttaatgaaacttgaaaaactaacagatattagacccattcctgataaagaatttgtagaaacttatattaaagcttattacctaactgagaatgacatggaacggtggatcaaagagcacagggaatattcaacgaagcagctgaccaatctggtgaatgtttgcctgggatcccatatcaataagaaagcaagacaaaaacttctagcagctatagatgatatagacagacctaaaagataa

SEQ ID NO: 14013 - DNA, 983 bp, Artificial Sequence
  Synthetic polypeptide
gcagaggaaggaatgacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14014 - DNA, 353 bp, Artificial Sequence; identical to SEQ ID NO: 10189
  Synthetic polypeptide

SEQ ID NO: 14015 - DNA, 317 bp, Artificial Sequence; identical to SEQ ID NO: 10190
  Synthetic polypeptide

SEQ ID NO: 14016 - DNA, 2084 bp, Artificial Sequence; identical to SEQ ID NO: 10260
  Synthetic polypeptide

SEQ ID NO: 14017 - DNA, 1946 bp, Artificial Sequence; identical to SEQ ID NO: 10261
  Synthetic polypeptide

SEQ ID NO: 14018 - DNA, 647 bp, Artificial Sequence; identical to SEQ ID NO: 10262
  Synthetic polypeptide

SEQ ID NO: 14019 - DNA, 182 bp, Artificial Sequence; identical to SEQ ID NO: 10263
  Synthetic polypeptide

SEQ ID NO: 14020 - DNA, 506 bp, Artificial Sequence
  Synthetic polypeptide
ctgcctctaacactgatggtcctgtgactctgatgaatcattgaaccttcctgagcctgagcctccttttgtgcaaggacaaagaagtgaacttggagcaggtccaccggcgcatgaacagcctcatggatgaagacattgctcacaagcagatttccccagcgtcgattgagctctcggccctggagatggggggcctggctcccacccagaccttggagccgacacgggagtaccagaacacccagctctcggtcagcacctttctgccagagcagagcagccatggcaccagccggacactctcatcagggcccagcagcaacctgccgctgccgctgagcagctcggcgaccatgccctccatgcagtgcaaacacaggtcacccaacggggggctgttccggcagagcccggtgaagacccccatccccatgtccttccagcccgtgcctggaggcgtccttccagaggctctggacacctcccacgggacctccatctga

SEQ ID NO: 14021 - DNA, 484 bp, Artificial Sequence
  Synthetic polypeptide
tagcagggcagaattaatcatcacagctggtggggagaatgtgccccctgtgcccatcgaggaggccgtgaagatggagctgcccatcatcagcaacgccatgctcattggggaccagaggaagttcctgtccatgctgctcaccttgaagtgcactctggacccagacacctctgaccagactgataatctgactgaacaagctatggagttctgccagagggtgggcagcagagccaccacagtgtccgagatcatagagaagaaggatgaggccgtgtaccaggccatcgaagaggggatccggagggtcaacatgaacgcggcggcccggccctaccacatccagaagtgggccattctcgagagagacttctccatttcgggtggagagttgggtcccacgatgaaactgaaacggctcacagttttggagaagtacaaaggtatcattgactccttttaccaagagcaaaaaatgtaa

SEQ ID NO: 14022 - DNA, 650 bp, Artificial Sequence; identical to SEQ ID NO: 9089
  Synthetic polypeptide

SEQ ID NO: 14023 - DNA, 1052 bp, Artificial Sequence; identical to SEQ ID NO: 9090
  Synthetic polypeptide

SEQ ID NO: 14024 - DNA, 1112 bp, Artificial Sequence
  Synthetic polypeptide
gcagaggaaggaatgagtcaaacgtcagcatggccagtttaggggaaaagagggaccaccattcaacccactacagggcttcagaggaagaacctgaatatggagaagaaataaagggttatccaggcgtccaggcccctgaggacctggagtgggagcgctataggggcagaggaagtgaagaatacagggctccaagacctcagagtgaggagagttgggatgaggaggacaagagaaactaccccagcttagagcttgataagatggcacatggatatggtgaagaaagtgaggaagagaggggccttgagccgggaaagggacgccatcacagaggcaggggaggggagccacgtgcctatttcatgtctgacaccagagaagagaaaaggttcttgggtgaaggacaccaccgtgtccaagaaaaccagatggacaaggcaaggaggcatccacaaggtgcgtggaaagagctggacagaaattatctcaactacggtgaggaaggagccccagggaagtggcagcagcagggagacctgcaggacactaaagaaaacagggaggaagctaggtttcaagataaacaatatagctcccatcacacagctgaaaagaggaagagattaggggaactgttcaacccatactacgaccctctccagtggaagagcagccattttgaaagaagagacaacatgaatgacaattttctcgagggtgaggaggaaaatgagctgaccttgaacgagaagaatttcttcccagaatacaactatgactggtgggagaaaaagcccttctctgaggatgtgaactgggggtatgagaagagaaacctcgccagggtccccaagctggacctgaaaaggcaatatgacagggtggcccaactggaccagctccttcactacaggaagaagtcagctgagtttccagacttctatgattctgaggagccggtgagcacccaccaggaggcagaaaatgaaaaggacagggctgaccagacagtcctgacagaggacgagaaaaaagaactcgaaaacttggctgcaatggatttggaactacagaagatagctgagaaattcagccaaaggggctga

SEQ ID NO: 14025 - DNA, 790 bp, Artificial Sequence; identical to SEQ ID NO: 10723
  Synthetic polypeptide

SEQ ID NO: 14026 - DNA, 466 bp, Artificial Sequence; identical to SEQ ID NO: 10724
  Synthetic polypeptide

SEQ ID NO: 14027 - DNA, 763 bp, Artificial Sequence; identical to SEQ ID NO: 10725
  Synthetic polypeptide

SEQ ID NO: 14028 - DNA, 585 bp, Artificial Sequence; identical to SEQ ID NO: 10726
  Synthetic polypeptide

SEQ ID NO: 14029 - DNA, 311 bp, Artificial Sequence; identical to SEQ ID NO: 10727
  Synthetic polypeptide

SEQ ID NO: 14030 - DNA, 1188 bp, Artificial Sequence; identical to SEQ ID NO: 11150
  Synthetic polypeptide

SEQ ID NO: 14031 - DNA, 636 bp, Artificial Sequence; identical to SEQ ID NO: 11151
  Synthetic polypeptide

SEQ ID NO: 14032 - DNA, 452 bp, Artificial Sequence; identical to SEQ ID NO: 11152
  Synthetic polypeptide

SEQ ID NO: 14033 - DNA, 729 bp, Artificial Sequence; identical to SEQ ID NO: 11153
  Synthetic polypeptide

SEQ ID NO: 14034 - DNA, 1224 bp, Artificial Sequence; identical to SEQ ID NO: 11154
  Synthetic polypeptide

SEQ ID NO: 14035 - DNA, 1143 bp, Artificial Sequence; identical to SEQ ID NO: 11155
  Synthetic polypeptide

SEQ ID NO: 14036 - DNA, 906 bp, Artificial Sequence; identical to SEQ ID NO: 11156
  Synthetic polypeptide

SEQ ID NO: 14037 - DNA, 822 bp, Artificial Sequence; identical to SEQ ID NO: 11157
  Synthetic polypeptide

SEQ ID NO: 14038 - DNA, 885 bp, Artificial Sequence; identical to SEQ ID NO: 11158
  Synthetic polypeptide

SEQ ID NO: 14039 - DNA, 935 bp, Artificial Sequence; identical to SEQ ID NO: 10282
  Synthetic polypeptide

SEQ ID NO: 14040 - DNA, 383 bp, Artificial Sequence; identical to SEQ ID NO: 10283
  Synthetic polypeptide

SEQ ID NO: 14041 - DNA, 199 bp, Artificial Sequence; identical to SEQ ID NO: 10284
  Synthetic polypeptide

SEQ ID NO: 14042 - DNA, 476 bp, Artificial Sequence; identical to SEQ ID NO: 10285
  Synthetic polypeptide

SEQ ID NO: 14043 - DNA, 971 bp, Artificial Sequence; identical to SEQ ID NO: 10286
  Synthetic polypeptide

SEQ ID NO: 14044 - DNA, 890 bp, Artificial Sequence; identical to SEQ ID NO: 10287
  Synthetic polypeptide

SEQ ID NO: 14045 - DNA, 653 bp, Artificial Sequence; identical to SEQ ID NO: 10288
  Synthetic polypeptide

SEQ ID NO: 14046 - DNA, 569 bp, Artificial Sequence; identical to SEQ ID NO: 10289
  Synthetic polypeptide

SEQ ID NO: 14047 - DNA, 632 bp, Artificial Sequence; identical to SEQ ID NO: 10290
  Synthetic polypeptide

SEQ ID NO: 14048 - DNA, 643 bp, Artificial Sequence
  Synthetic polypeptide
aacttctgttttcacgttgatctgtacaaagaagataatggagattatttatctaaagtggatgttataaagattaaatgaaattaaatatggaaattacctaccagaatgcctggcacttgataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataa

SEQ ID NO: 14049 - DNA, 691 bp, Artificial Sequence
  Synthetic polypeptide
aacttctgttttcacgttgatctgtacaaagaagataatggagattatttatctaaagtggatgttataaagattaaatgaaattaaatatggaaattacctaccagaatgcctggcacttgataaacaacttgatgcagatgtttcccccaagcccactatttttcttccttcgattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataa

SEQ ID NO: 14050 - DNA, 2327 bp, Artificial Sequence; identical to SEQ ID NO: 9672
  Synthetic polypeptide

SEQ ID NO: 14051 - DNA, 1916 bp, Artificial Sequence; identical to SEQ ID NO: 9673
  Synthetic polypeptide

SEQ ID NO: 14052 - DNA, 2384 bp, Artificial Sequence; identical to SEQ ID NO: 9674
  Synthetic polypeptide

SEQ ID NO: 14053 - DNA, 2195 bp, Artificial Sequence; identical to SEQ ID NO: 9675
  Synthetic polypeptide

SEQ ID NO: 14054 - DNA, 2270 bp, Artificial Sequence
  Synthetic polypeptide
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14055 - DNA, 2177 bp, Artificial Sequence
  Synthetic polypeptide
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14056 - DNA, 242 bp, Artificial Sequence
  Synthetic polypeptide
tgctctcccctccccctacaggcctccatcctcttcatcctgttcatttttcagatctcagttcaagcatctcgtcctcagtgtggtgtttcctgatccctcactctaatccaagtctttctgttttatgcacagggtggtttataaaatcctccaatgaagctactaacattactccaaagcataatatgaaagcatttttggatgaattgaaagctgagaacatcaagaagttcttataa

SEQ ID NO: 14057 - DNA, 826 bp, Artificial Sequence
  Synthetic polypeptide
aacacacggacacaacctcttttccatctgactggtacaaggtgctaactttgagtacatcatcgcagaaaaaagagggaagaataacaccgtggggttgatccaactgaaccgccccaaggccctcaatgcactttgcgatggcctgattgacgagctcaaccaggccctgaagaccttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcactggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtga

SEQ ID NO: 14058 - DNA, 368 bp, Artificial Sequence; identical to SEQ ID NO: 6482
  Synthetic polypeptide

SEQ ID NO: 14059 - DNA, 561 bp, Artificial Sequence
  Synthetic polypeptide
gtgtgatggaatgtgccattgcctttggtgtcatacagagatgattttagatgcctgttcactcactgtctgtgtaactctgtgcaaaataagaaacaaggatgtaaaaatgaggaggtactcgctgtactaggccatgaactggggcactggaagttgggacatacagtcaaaaatatcattattagccagatgaattctttcctgtgtttttttttatttgctgtattaattggtcgaaaggagctttttgctgcatttggtttttatgatagccaacccactcttattggactattgatcatcttccagtttattttttcaccttacaatgaggttctttctttttgcctaacagtcctaagccgcagatttgagtttcaagctgatgcatttgccaagaaacttgggaaggctaaagacttatattctgctttaatcaaacttaacaaagataacttgggattccctgtttctgactggttgttctcaatgtggcattattctcatcctccactgctagagagacttcaagctttgaaaactatgaagcaacactga

SEQ ID NO: 14060 - DNA, 942 bp, Artificial Sequence; identical to SEQ ID NO: 10396
  Synthetic polypeptide

SEQ ID NO: 14061 - DNA, 390 bp, Artificial Sequence; identical to SEQ ID NO: 10397
  Synthetic polypeptide

SEQ ID NO: 14062 - DNA, 206 bp, Artificial Sequence; identical to SEQ ID NO: 10398
  Synthetic polypeptide

SEQ ID NO: 14063 - DNA, 483 bp, Artificial Sequence; identical to SEQ ID NO: 10399
  Synthetic polypeptide

SEQ ID NO: 14064 - DNA, 978 bp, Artificial Sequence; identical to SEQ ID NO: 10400
  Synthetic polypeptide

SEQ ID NO: 14065 - DNA, 897 bp, Artificial Sequence; identical to SEQ ID NO: 10401
  Synthetic polypeptide

SEQ ID NO: 14066 - DNA, 660 bp, Artificial Sequence; identical to SEQ ID NO: 10402
  Synthetic polypeptide

SEQ ID NO: 14067 - DNA, 576 bp, Artificial Sequence; identical to SEQ ID NO: 10403
  Synthetic polypeptide

SEQ ID NO: 14068 - DNA, 639 bp, Artificial Sequence; identical to SEQ ID NO: 10404
  Synthetic polypeptide

SEQ ID NO: 14069 - DNA, 742 bp, Artificial Sequence; identical to SEQ ID NO: 6357
  Synthetic polypeptide

SEQ ID NO: 14070 - DNA, 590 bp, Artificial Sequence; identical to SEQ ID NO: 6358
  Synthetic polypeptide

SEQ ID NO: 14071 - DNA, 577 bp, Artificial Sequence; identical to SEQ ID NO: 6359
  Synthetic polypeptide

SEQ ID NO: 14072 - DNA, 430 bp, Artificial Sequence; identical to SEQ ID NO: 6360
  Synthetic polypeptide

SEQ ID NO: 14073 - DNA, 670 bp, Artificial Sequence; identical to SEQ ID NO: 6361
  Synthetic polypeptide

SEQ ID NO: 14074 - DNA, 330 bp, Artificial Sequence; identical to SEQ ID NO: 6490
  Synthetic polypeptide

SEQ ID NO: 14075 - DNA, 1410 bp, Artificial Sequence
  Synthetic polypeptide
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaa

SEQ ID NO: 14076 - DNA, 1548 bp, Artificial Sequence
  Synthetic polypeptide
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcattgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattgatacaaaaaaacctctatttactagctttcaagaagagcaaaaaatcatcccactgcctgctaactgcccatctattgcggttatggatgtttctgagaatattagagcaaaaatttatgctatattgggcaaactagattttgaaaatttacctggcctatctgctgaagattttgtcaccctttgtatcatacatagatatcttgattttaaaattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaaatacaggccacgcacaagcaaagagagctggctaataaatcatgggaagatttcttggctagaacatcaaacgctaaaacgttaaagaaagcaaaaagccttcaagaaaaagctatagaagcctccagataccataaacgaccacaaaatgcaatatttcaccaaacacatattaaaggccttaacacaacggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaa

SEQ ID NO: 14077 - DNA, 618 bp, Artificial Sequence
  Synthetic polypeptide
ggccaggtgcagtagctcacacctgtaatcccaacactttcaaggcaggaggatcacttgaggccagaagttcaagaccagcctgggcaacatgatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggaatctttaaaaatataataagcaagcctaatgaaaaggaagaagccattgttttggaaatccagtctgatatattacttatcctatctggcctttgtgagaatcacattcaaaggaaggaaattttcggaactgaaggagtagatatcgttcttcatgtgatgaaaacagaccccaggaagttacagagtggcttaggctataatgtacttctttttagtacattggacagcatttggtgctgtattttgggatgttatccctcagaggattattttcttgaaaaggaaggcatttttctccttttggatttgttagcaaaggatcagacagctgctagtcttttaattaaattgtgg

SEQ ID NO: 14078 - DNA, 2157 bp, Artificial Sequence; identical to SEQ ID NO: 6426
  Synthetic polypeptide

SEQ ID NO: 14079 - DNA, 799 bp, Artificial Sequence; identical to SEQ ID NO: 6427
  Synthetic polypeptide

SEQ ID NO: 14080 - DNA, 336 bp, Artificial Sequence; identical to SEQ ID NO: 6428
  Synthetic polypeptide

SEQ ID NO: 14081 - DNA, 1205 bp, Artificial Sequence; identical to SEQ ID NO: 11461
  Synthetic polypeptide

SEQ ID NO: 14082 - DNA, 653 bp, Artificial Sequence; identical to SEQ ID NO: 11462
  Synthetic polypeptide

SEQ ID NO: 14083 - DNA, 469 bp, Artificial Sequence; identical to SEQ ID NO: 11463
  Synthetic polypeptide

SEQ ID NO: 14084 - DNA, 746 bp, Artificial Sequence; identical to SEQ ID NO: 11464
  Synthetic polypeptide

SEQ ID NO: 14085 - DNA, 1241 bp, Artificial Sequence; identical to SEQ ID NO: 11465
  Synthetic polypeptide

SEQ ID NO: 14086 - DNA, 1160 bp, Artificial Sequence; identical to SEQ ID NO: 11466
  Synthetic polypeptide

SEQ ID NO: 14087 - DNA, 923 bp, Artificial Sequence; identical to SEQ ID NO: 11467
  Synthetic polypeptide

SEQ ID NO: 14088 - DNA, 839 bp, Artificial Sequence; identical to SEQ ID NO: 11468
  Synthetic polypeptide

SEQ ID NO: 14089 - DNA, 902 bp, Artificial Sequence; identical to SEQ ID NO: 11469
  Synthetic polypeptide

SEQ ID NO: 14090 - DNA, 407 bp, Artificial Sequence
  Synthetic polypeptide
gtgtattagcggtggaaaataataggaacaaggcgagacctggacttcagtcccagctctgccactaagtggcttggctgtagagcttaactcttccacagtcttcatctgtgtaatgggaataacgatccgtacctctagcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctga

SEQ ID NO: 14091 - DNA, 1070 bp, Artificial Sequence
  Synthetic polypeptide
tgtaaaaagtaaagtaaaggttcctcttcaaagactttcctccccgtctaattagaaataaacagtaacttctcttaaaaacaaaatttattcaaagacctgtgctaacattcttaaatatctgctagctgtaataataaaaaaaaatgtactttacattcttatcttccacaatttagcctaaatatttgccctggcatgcttatactggtccaagcaagcattaagttatagcctgttcctcttccttatttaaaggtgtttttacctttctcagcattcctcaagttacttcctccttcctttgttctcctctgcctttgcctcttaaacatttctaagttgctagccaattgagacaaatacagattgtgaggtcccgttccagccaataaaaacgggacacagctgtaaagtggacgcatcaggttataaatgaccttgtctcctttgttcaatatacagtcgcggcaaaactgctgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataa

SEQ ID NO: 14092 - DNA, 1124 bp, Artificial Sequence
  Synthetic polypeptide
tgtaaaaagtaaagtaaaggttcctcttcaaagactttcctccccgtctaattagaaataaacagtaacttctcttaaaaacaaaatttattcaaagacctgtgctaacattcttaaatatctgctagctgtaataataaaaaaaaatgtactttacattcttatcttccacaatttagcctaaatatttgccctggcatgcttatactggtccaagcaagcattaagttatagcctgttcctcttccttatttaaaggtgtttttacctttctcagcattcctcaagttacttcctccttcctttgttctcctctgcctttgcctcttaaacatttctaagttgctagccaattgagacaaatacagattgtgaggtcccgttccagccaataaaaacgggacacagctgtaaagtggacgcatcaggttataaatgaccttgtctcctttgttcaatatacagtcgcggcaaaactgctgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagaaactactccaaaccagggggccactggctaacttgaataatccagaaggcttggaatatctatccatcaaatttgggcattaa

SEQ ID NO: 14093 - DNA, 647 bp, Artificial Sequence
  Synthetic polypeptide
ccctgtgcctcagtttcctcatctgtaagatacaggggctggagagaatggtggggttctaagactaattcccagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctga

SEQ ID NO: 14094 - DNA, 599 bp, Artificial Sequence
  Synthetic polypeptide
ccctgtgcctcagtttcctcatctgtaagatacaggggctggagagaatggtggggttctaagactaattcccagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctga

SEQ ID NO: 14095 - DNA, 1137 bp, Artificial Sequence; identical to SEQ ID NO: 11406
  Synthetic polypeptide

SEQ ID NO: 14096 - DNA, 585 bp, Artificial Sequence; identical to SEQ ID NO: 11407
  Synthetic polypeptide

SEQ ID NO: 14097 - DNA, 401 bp, Artificial Sequence; identical to SEQ ID NO: 11408
  Synthetic polypeptide

SEQ ID NO: 14098 - DNA, 678 bp, Artificial Sequence; identical to SEQ ID NO: 11409
  Synthetic polypeptide

SEQ ID NO: 14099 - DNA, 1173 bp, Artificial Sequence; identical to SEQ ID NO: 11410
  Synthetic polypeptide

SEQ ID NO: 14100 - DNA, 1092 bp, Artificial Sequence; identical to SEQ ID NO: 11411
  Synthetic polypeptide

SEQ ID NO: 14101 - DNA, 855 bp, Artificial Sequence; identical to SEQ ID NO: 11412
  Synthetic polypeptide

SEQ ID NO: 14102 - DNA, 771 bp, Artificial Sequence; identical to SEQ ID NO: 11413
  Synthetic polypeptide

SEQ ID NO: 14103 - DNA, 834 bp, Artificial Sequence; identical to SEQ ID NO: 11414
  Synthetic polypeptide

SEQ ID NO: 14104 - DNA, 460 bp, Artificial Sequence
  Synthetic polypeptide
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatggcctccaactacaaggagctgggcttccagggctag

SEQ ID NO: 14105 - DNA, 424 bp, Artificial Sequence
  Synthetic polypeptide
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggagttcatctcggaatgcatcatccaggttctgcagagcaagcatcccggggactttggtgctgatgcccagggggccatgaacaaggccctggagctgttccggaaggacatg

SEQ ID NO: 14106 - DNA, 313 bp, Artificial Sequence
  Synthetic polypeptide
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatccttaagaagaaggggcatcatgaggcagagattaagcccctggcacagtcgcatgccaccaagcacaagatccccgtgaagtacctggag

SEQ ID NO: 14107 - DNA, 227 bp, Artificial Sequence
  Synthetic polypeptide
tgggaggttcagagagtcacagcttgggctcaaaacaagcaagaggtttctgagtgtgaggattgctctggagtggaatggccctcacaggctctttaagggtcacccagagactctggagaagtttgacaagttcaagcacctgaagtcagaggacgagatgaaggcgtctgaggacttaaagaagcatggtgccaccgtgctcaccgccctgggtggcatcctta

SEQ ID NO: 14108 - DNA, 725 bp, Artificial Sequence
  Synthetic polypeptide
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttga

SEQ ID NO: 14109 - DNA, 695 bp, Artificial Sequence
  Synthetic polypeptide
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtaa

SEQ ID NO: 14110 - DNA, 401 bp, Artificial Sequence
  Synthetic polypeptide
aggcagaatatcagttgactagagcggcatactagaaatcaggaaattcaacttctggccttggctgggtcagtgattttatgatatttgtcatatcttttgaacattctgtaccttggcttctccatctgttaaactgaattcataataactgtcctggtctgtctcacaggaatgttgcatggacaaattagataagtgtaaaagtgccttggagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatag

SEQ ID NO: 14111 - DNA, 899 bp, Artificial Sequence
  Synthetic polypeptide
aggaatgaactattgatgcgtgcagcagcctggatgcatctcaaggaaatgatgctgagtgagaaagcagcatatgcagaagggaacatactgtacgattctgcttccatgacattctggaaataacagaattatgacagtggagaacagatgagtagttgccaaagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14112 - DNA, 361 bp, Artificial Sequence
  Synthetic polypeptide
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaa

SEQ ID NO: 14113 - DNA, 1046 bp, Artificial Sequence
  Synthetic polypeptide
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagtggtaggaatgggatcctggtgcttccacatgactctgaaatatgaaatgcagctattggatgaactcccaatgatatacagctgttgcatatttgtgtactgcatgtttgaatgtttcaagatcaagaactcagtaaactaccatctgctttttaccttagttctattcagtttaatagtaaccacagtttaccttaaggtaaaagagccgatattccatcaggtcatgtatggaatgttggtctttacattagtacttcgatctatttatattgttacatgggtttatccatggcttagaggactgggttatacatcattgggtatatttttattgggatttttattttggaatatagataacatattttgtgagtcactgaggaactttcgaaagaaggtaccacctatcataggtattaccacacaatttcatgcatggtggcatattttaactggccttggttcctatcttcacatccttttcagtttgtatacaagaacactttacctgagatataggccaaaagtgaagtttctctttggaatctggccagtgatcctgtttgagcctctcaggaagcattga

SEQ ID NO: 14114 - DNA, 485 bp, Artificial Sequence
  Synthetic polypeptide
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagatggagtctcactctgtcgccgaggctga

SEQ ID NO: 14115 - DNA, 467 bp, Artificial Sequence
  Synthetic polypeptide
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagctattggatga

SEQ ID NO: 14116 - DNA, 473 bp, Artificial Sequence
  Synthetic polypeptide
tgtggtcgttatcaatttattacttcttagctctgagttcaacattcattgcatggttggtgaaaatagacctgagccctttgaatattttcctttgacaactggctggatgttaaattttgtcaatagagggcgccagagagacattgcaagaggaagagattttccttcctggttctggtgtgctggcttggcaacttctctggcgccagctcttgcagtccaagtggcttaatagcttctggctcctacagtgctgaggcttccccagtgcccacctcttaaagcttggtcagcttctggtgccaggctattgcagaacgtggctgtcagcagcacctagtgggaatacagtgagtaacctgatcatgattatacctccaatgttcggtgcagttcagagtgttagagacggtctggaaaagcggtacattgcttcttatttagcactcacagaagtacttcagatttga

SEQ ID NO: 14117 - DNA, 1453 bp, Artificial Sequence
  Synthetic polypeptide
gatggtgtcagaaataggacctatagtagaacttccagcgacccccggaagcatagagtgaccaaatggtgtacccgctgggcccattgtgtccattgctctctcgcagccactggggatcgtgggtaagttctctttcagactttgaagctccacggctttgtgttctgagctatctgagtttgtttgagcagatttttttttttttttatctgaactgggtttggaagttgttacagaaactggactgggtccaggatcaaattaggtctgataattaactgacttagatctagttaaaggcctcagatgtctgaatcagacagaaactgacagtaaatggcaatattgtaggtagtatgaacttcagctttcagaaatttgcagggacttttgtgttctatcccctttgtttctttttcttgcactcataggtaggaaaaaagtcaatgactaagttgtgaggaaatctgagagccaaagccaagattcaacataaaaatgagatccttaatttctgaagaactgagtactccactttctggctacaactacctacaaacacttacaaaaatggcaaaatgttactaaagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcagtataaaaaagcaatattgacactggtaaagcagaaatacttggattcatttactccatgctggttaaatctaaagaatactccagtggggagaggaatcttgagggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaa

SEQ ID NO: 14118 - DNA, 68 bp, Artificial Sequence; identical to SEQ ID NO: 6862
  Synthetic polypeptide

SEQ ID NO: 14119 - DNA, 1053 bp, Artificial Sequence; identical to SEQ ID NO: 6863
  Synthetic polypeptide

SEQ ID NO: 14120 - DNA, 407 bp, Artificial Sequence; identical to SEQ ID NO: 6864
  Synthetic polypeptide

SEQ ID NO: 14121 - DNA, 673 bp, Artificial Sequence; identical to SEQ ID NO: 6865
  Synthetic polypeptide

SEQ ID NO: 14122 - DNA, 1204 bp, Artificial Sequence; identical to SEQ ID NO: 11522
  Synthetic polypeptide

SEQ ID NO: 14123 - DNA, 652 bp, Artificial Sequence; identical to SEQ ID NO: 11523
  Synthetic polypeptide

SEQ ID NO: 14124 - DNA, 468 bp, Artificial Sequence; identical to SEQ ID NO: 11524
  Synthetic polypeptide

SEQ ID NO: 14125 - DNA, 745 bp, Artificial Sequence; identical to SEQ ID NO: 11525
  Synthetic polypeptide

SEQ ID NO: 14126 - DNA, 1240 bp, Artificial Sequence; identical to SEQ ID NO: 11526
  Synthetic polypeptide

SEQ ID NO: 14127 - DNA, 1159 bp, Artificial Sequence; identical to SEQ ID NO: 11527
  Synthetic polypeptide

SEQ ID NO: 14128 - DNA, 922 bp, Artificial Sequence; identical to SEQ ID NO: 11528
  Synthetic polypeptide

SEQ ID NO: 14129 - DNA, 838 bp, Artificial Sequence; identical to SEQ ID NO: 11529
  Synthetic polypeptide

SEQ ID NO: 14130 - DNA, 901 bp, Artificial Sequence; identical to SEQ ID NO: 11530
  Synthetic polypeptide

SEQ ID NO: 14131 - DNA, 1435 bp, Artificial Sequence
  Synthetic polypeptide
tgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacagaattccaagaagcaaagtccaccaaaaaatgtagtggaaccaaaggagaggggcaagctcctagccacccagacagcagctgaattgtctaaaaacttatcttcacccagttcttacccgccagctgtgaataagggcaggaaggtagctagtcccagtcccagtggcagcgtgctattcacagatgaaggggttccgaaatttttgtcaagaaagactttggtagagtttccacagaaagttctgtctccattcagaaaacagggctctgattcagaagctcgtcaggtgggtcggaaagtgacgtcgccttcgtcttcatcctcttccagctcctctgattctgaatctgatgatgaggctgacgtttcagaggtcactcctcgagtggtgagcaaaggcagaggggggcttcgaaaaccagaggcctctcattcctttgaaaacagagccccccgagttacagtatcagcaaaagagaaaaccttgctgcagaagccgcatgtggacattactgatccagagaagccccaccagccaaagaagaaagggtcccctgctaagccatcagaaggcagggaaaatgcgagaccaaaaaccacaatgcccagatctcaagtagatgaagagtttttgaagcaaagtttaaaggaaaaacaattgcagaaaacatttagattaaatgaaatagataaagaaagccaaaagccatttgaagttaaaggacccttacctgtccacacaaaatcagggttgtctgcgccaccgaagggcagcccagcgcctgctgtgttggcagaagaggccagagcagaggggcagctgcaagccagtcctcctggggcggcagaggggcatctggaaaaacccgtgccagagccccagcgcaaggcggcccctcccctgcccagaaaggaaacctcagggacgcagggaatagaaggccacctgaagggtggacaggcaatcgtggaagatcagataccaccaagcaatttggagacagttcctgttgagaataaccacggtttccatgaaaagacagcagcgctgaagcttgaggccgagggcgaggccatggaagatgcagccgcgccaggggacgaccgaggcggcacacaggagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactga

SEQ ID NO: 14132 - DNA, 340 bp, Artificial Sequence
  Synthetic polypeptide
tgtttcctgaacggctcctgctcctgctggacaagcccacagagggcccagcttccaacagactatgctccaggaagcccaggtgtttcgaggacttgcttctacggtttctttgtctgcggaatcagggaagagtgaaaagggtcagccacagaattccaagaagcaaagtccaccaaaaaagccagccccagtgcctgctgagccgtttgacaacactacctacaagaacctgcagcatcatgactacagcacgtacaccttcttagacctcaacctcgaactctcaaaattcaggatgcctcagccctcctcaggccgggagtcacctcgacactga

SEQ ID NO: 14133 - DNA, 425 bp, Artificial Sequence; identical to SEQ ID NO: 6825
  Synthetic polypeptide

SEQ ID NO: 14134 - DNA, 1013 bp, Artificial Sequence; identical to SEQ ID NO: 6826
  Synthetic polypeptide

SEQ ID NO: 14135 - DNA, 413 bp, Artificial Sequence; identical to SEQ ID NO: 6827
  Synthetic polypeptide

SEQ ID NO: 14136 - DNA, 854 bp, Artificial Sequence; identical to SEQ ID NO: 6828
  Synthetic polypeptide

SEQ ID NO: 14137 - DNA, 1393 bp, Artificial Sequence
  Synthetic polypeptide
aaagccctatttttataggtagtggatgaagaagagtccttcccctatcccctatgtgagtcaggcattgtcagagagattatggaaggttgaagaaagtaaacctataaagttttatatgaacactccttagccattttgcatggatctgaccctaaacagcacatcagaggctttgaaaactagaatacacaatagactgcctctccagggccagcctggccattgggtggcaaataagtggggcagatgcaaataacatagcaaaggagttcataacaaacctgacactggaaccataacacaacctagaaacattgagtaaaaacttgaagcctaaaccaaaccagattgtctgctgaaagtttttaaaaatcaagacctagaatgatgtaacatgtcaaaatatccaggatgccatcctaaattagtcaacatactcaaaaccaggaaaatcttaacatctcaaaggaaaagacagcagacaccaacctcaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttga

SEQ ID NO: 14138 - DNA, 1581 bp, Artificial Sequence
  Synthetic polypeptide
atggttaattttatgtgtcaagctgacttggtcatgggatgcccaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14139 - DNA, 391 bp, Artificial Sequence
  Synthetic polypeptide
cagtggtccccaacccctgggccacagaccagtactagtctgtgtggcctgttaggaacctggccacacagcaggaggtgagcggtggacaagaaaacaaagcttgctccccatcactcacgttaccgcctgacctctgcctcctgtcagatcgtcggcggcattagattctcataggagcacgaaccctgtgaacattgtgaaatgtgcatgctagggatctagcttgcatctaccttatgagaatctagtgcctgatcatctgtcattgtctcccatcacccccagatgggaccatctagttgcaggaaaacaagctcagggatcccactgattctacattatgagatgggatctcgctgtgttgtcctggctggtctcaaactcctag

SEQ ID NO: 14140 - DNA, 1389 bp, Artificial Sequence
  Synthetic polypeptide
tgtgagggttaatattaggggtcaacctgattggattgaaggatgcctaggcagctggaaaagtcttgtttctgggtatgtctctgagggtattgccagaggagactgccatttgagtcagtggactgagagaggaagactcaccctcaacatgggtgggcactatccaatcggctgctagcacggctagaacaaagcaggtggaagaaggtgttataaccttgcttgcctgccgagtcttctgatttccttctttttcctaagccagatgcttccttccactctttctgcccttggacatcagaatccagattctttggcctttggactctaggacttgcatcagtggcttcctgggggctctcagaccttcagccacagactgaagcctgcacttgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatga

SEQ ID NO: 14141 - DNA, 452 bp, Artificial Sequence
  Synthetic polypeptide
caggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatgggctgccggggagcgctatcgcagggagatgctggcccacggtggaggcagggagcccatgctcatggttgaaggtatgcttcagaagtgtccttctgttgatgacttcgtaa

SEQ ID NO: 14142 - DNA, 511 bp, Artificial Sequence
  Synthetic polypeptide
caggagtccccaacccccaggccacagactggtactgggaactgggccacacagcaggaggtgtggtgggtgggtgagcaagtgaagcttcatctgtatttgcagccgctccccatccatctcctgttgaattagtggcagcattagattctcataggagcaggaaccctactgtgaactgcgcatgtgatccttatgatcctctcacaaggatctaggatgggcactccttatgagactctgaggcctgatgatctgtcactgtctcccatcacccctggatggtaccatctagttgtagaaaaacaagctcagggctcccactgattctacattatgggctgccggggagcgctatcgcagggagatgctggcccacggtggaggcagggagcccatgctcatggttgaaggtatgcttcagaagtgtccttctgttgatgacttcgtaagtgccctcgtttccgacttggatctggacttcgaaactttcctcatggattctgaataa

SEQ ID NO: 14143 - DNA, 820 bp, Artificial Sequence; identical to SEQ ID NO: 9718
  Synthetic polypeptide

SEQ ID NO: 14144 - DNA, 307 bp, Artificial Sequence; identical to SEQ ID NO: 9719
  Synthetic polypeptide

SEQ ID NO: 14145 - DNA, 622 bp, Artificial Sequence; identical to SEQ ID NO: 9720
  Synthetic polypeptide

SEQ ID NO: 14146 - DNA, 718 bp, Artificial Sequence; identical to SEQ ID NO: 9721
  Synthetic polypeptide

SEQ ID NO: 14147 - DNA, 409 bp, Artificial Sequence; identical to SEQ ID NO: 9722
  Synthetic polypeptide

SEQ ID NO: 14148 - DNA, 691 bp, Artificial Sequence; identical to SEQ ID NO: 9723
  Synthetic polypeptide

SEQ ID NO: 14149 - DNA, 751 bp, Artificial Sequence; identical to SEQ ID NO: 9724
  Synthetic polypeptide

SEQ ID NO: 14150 - DNA, 838 bp, Artificial Sequence; identical to SEQ ID NO: 9725
  Synthetic polypeptide

SEQ ID NO: 14151 - DNA, 536 bp, Artificial Sequence; identical to SEQ ID NO: 7623
  Synthetic polypeptide

SEQ ID NO: 14152 - DNA, 369 bp, Artificial Sequence; identical to SEQ ID NO: 7297
  Synthetic polypeptide

SEQ ID NO: 14153 - DNA, 2239 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14154 - DNA, 2227 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14155 - DNA, 1418 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagagactaagaaagcactgtgcatcaccttgaccctggggaccttcctcgtgggagctgcgctggccgctggcctactctggaagttcattcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14156 - DNA, 2462 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14157 - DNA, 2450 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14158 - DNA, 1641 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcattcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14159 - DNA, 1221 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaa

SEQ ID NO: 14160 - DNA, 751 bp, Artificial Sequence
  Synthetic polypeptide
gatgacaagtaggtaatatttagcatgctaactctgactttctgtttaactccagtgctgtttggcgctctgtgctgataagaatcctaaagcctcgtgtggtcttagcgggaaagagcactaggctagacgagaagtgtgtgccacggtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttag

SEQ ID NO: 14161 - DNA, 835 bp, Artificial Sequence
  Synthetic polypeptide
gatgacaagtaggtaatatttagcatgctaactctgactttctgtttaactccagtgctgtttggcgctctgtgctgataagaatcctaaagcctcgtgtggtcttagcgggaaagagcactaggctagacgagaagtgtgtgccacggtccatgaaggctctggagaaactagtcaaaaggagacatccacctgtgatatttgccagtttggtgcagaatgtgacgaagatgccgaggatgtctggtgtgtgtgtaatattgactgttctcaaaccaacttcaatcccctctgcgcttctgatgggaaatcttatgataatgcatgccaaatcaaagaagcatcgtgtcagaaacaggagaaaattgaagtcatgtctttgggtcgatgtcaagataacacaactacaactactaagtctgaagatgggcattatgcaagaacagattatgcagagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaa

SEQ ID NO: 14162 - DNA, 131 bp, Artificial Sequence
  Synthetic polypeptide
ctgctctgtttgtgtccgcagcacgtggagacgttctcttccagatggctgaagtccacaggcagatccagaatcagctggaagaaatgccctgccctgcctcctgttccgggtccatgtgttggagctga

SEQ ID NO: 14163 - DNA, 223 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtca

SEQ ID NO: 14164 - DNA, 1376 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtga

SEQ ID NO: 14165 - DNA, 161 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggctgcgctga

SEQ ID NO: 14166 - DNA, 1415 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctga

SEQ ID NO: 14167 - DNA, 1349 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaa

SEQ ID NO: 14168 - DNA, 1373 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctga

SEQ ID NO: 14169 - DNA, 1469 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatga

SEQ ID NO: 14170 - DNA, 291 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaagg

SEQ ID NO: 14171 - DNA, 397 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgctt

SEQ ID NO: 14172 - DNA, 391 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgctt

SEQ ID NO: 14173 - DNA, 327 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagg

SEQ ID NO: 14174 - DNA, 688 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgccca

SEQ ID NO: 14175 - DNA, 525 bp, Artificial Sequence
  Synthetic polypeptide
ctgctctgtttgtgtccgcagcacgtggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagc

SEQ ID NO: 14176 - DNA, 853 bp, Artificial Sequence; identical to SEQ ID NO: 8074
  Synthetic polypeptide

SEQ ID NO: 14177 - DNA, 1789 bp, Artificial Sequence
  Synthetic polypeptide
cagtggtccccaacccctgggccacagaccagtactagtctgtgtggcctgttaggaacctggccacacagcaggaggtgagcggtggacaagaaaacaaagcttgctccccatcactcacgttaccgcctgacctctgcctcctgtcagatcgtcggcggcattagattctcataggagcacgaaccctgtgaacattgtgaaatgtgcatgctagggatctagcttgcatctaccttatgagaatctagtgcctgatcatctgtcattgtctcccatcacccccagatgggaccatctagttgcaggaaaacaagctcagggatcccactgattctacattatgacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14178 - DNA, 221 bp, Artificial Sequence
  Synthetic polypeptide
ggctgggcagggtggctcatgcctgtaatcccagcactttgggaggcgaggcaggcagatcacttgagggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaa

SEQ ID NO: 14179 - DNA, 73 bp, Artificial Sequence
  Synthetic polypeptide
ggctgggcagggtggctcatgcctgtaatcccagcactttgggaggcgaggcaggcagatcacttgagggtga

SEQ ID NO: 14180 - DNA, 5350 bp, Artificial Sequence; identical to SEQ ID NO: 655
  Synthetic polypeptide

SEQ ID NO: 14181 - DNA, 1775 bp, Artificial Sequence; identical to SEQ ID NO: 568
  Synthetic polypeptide

SEQ ID NO: 14182 - DNA, 469 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14183 - DNA, 680 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14184 - DNA, 167 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggccaggtga

SEQ ID NO: 14185 - DNA, 522 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14186 - DNA, 578 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14187 - DNA, 269 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14188 - DNA, 611 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14189 - DNA, 698 bp, Artificial Sequence
  Synthetic polypeptide
ggctgggcgcggtggctcacacctgtaatcccagcactttgggaggccaaggcaggtagatcacctgaggtcaggagttcgagaccagcctggccaactgcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14190 - DNA, 1429 bp, Artificial Sequence
  Synthetic polypeptide
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctga

SEQ ID NO: 14191 - DNA, 1537 bp, Artificial Sequence
  Synthetic polypeptide
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctga

SEQ ID NO: 14192 - DNA, 721 bp, Artificial Sequence
  Synthetic polypeptide
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagag

SEQ ID NO: 14193 - DNA, 698 bp, Artificial Sequence
  Synthetic polypeptide
ggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactc

SEQ ID NO: 14194 - DNA, 1540 bp, Artificial Sequence
  Synthetic polypeptide
gccaggtgtggtggctcacacctgtaatcccagcactttgggaggccaaggcaggaggatctcttgagcccaggagtttgcgaccagcctgggcaacaaagggagactccatctctacaaaaaatacaaaaattagctgggtgtgatgtacttgcctgtggtcccagctacttgggaggctgaggaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataa

SEQ ID NO: 14195 - DNA, 2032 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14196 - DNA, 2020 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagg

SEQ ID NO: 14197 - DNA, 1331 bp, Artificial Sequence
  Synthetic polypeptide
tcaagtggatgagatgacccattctgtagataccagtcagcctttccccagccactcctgtcatcacccaatgggctcatggacaaagtggcctcggtggcagggatggagattatgcatgggctcagcaacatggactcctactgaacaaggccaaactggctacagccacaactgagtgcccatctgccagcagcagagaccagcaccaaggctctgatatggcacggttccccagatgatcaggcagcaacctggtgtcaggtggattacattggaccaccttcagtatggaaggggcagcattttgtccttactggaataggcagtctggatacagatttgtcttccctgcacacagcgcttctggtggaactcacagaatgcctcatccaccatcatggtattccacatagcattgcttttgaccaaggaactgacttctcaaagaagcatggcaatgggcttatgctcatggaatcgactgatcttcccatattccccacccccatgaagcagctgacttgatagaatagtggaatcgccttttgaagatgcagttacagtgctggctaggggacaatgctctgcaggctggggcaaggttctccagaaagctgtgtatgctccaaatcagcatccaatatgcggtgctgtttctcccatagccaggattcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaagttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcg

SEQ ID NO: 14198 - DNA, 799 bp, Artificial Sequence
  Synthetic polypeptide
tttcagaagtcaaaagaggcccgagtcactcctaatttttaaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccgtctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtga

SEQ ID NO: 14199 - DNA, 3532 bp, Artificial Sequence
  Synthetic polypeptide
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14200 - DNA, 3673 bp, Artificial Sequence
  Synthetic polypeptide
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14201 - DNA, 2275 bp, Artificial Sequence
  Synthetic polypeptide
ggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctag

SEQ ID NO: 14202 - DNA, 1704 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14203 - DNA, 1104 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 14204 - DNA, 387 bp, Artificial Sequence
  Synthetic polypeptide
ggccaggcacagtggctcacgcctgtaatcccagcactttatgaatcccagcattcattagacgaggctgaggcaggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataa

SEQ ID NO: 14205 - DNA, 107 bp, Artificial Sequence
  Synthetic polypeptide
ggccaggcacggtggctcacgcctgtaatccaagcactttgggaggccaaggcggcggatcacgaggagatcgagaccatcctggctaacacggagactgtgcctga

SEQ ID NO: 14206 - DNA, 294 bp, Artificial Sequence; identical to SEQ ID NO: 6802
  Synthetic polypeptide

SEQ ID NO: 14207 - DNA, 996 bp, Artificial Sequence
  Synthetic polypeptide
gtgattaagtgcatagcctctggaataacaagatttgaattcaaacagcatttaatagctgtgtgagctgtttcctcatctgtaaaatggagacaataatgatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttga

SEQ ID NO: 14208 - DNA, 2406 bp, Artificial Sequence
  Synthetic polypeptide
ttaagcaaccactaccctgatcagtcggcagccagcaacataaaagcagtattccctctaacagcaaaaagattgcgacttactgaaggctcggatgatcgttgtcattttttagcaatatttttaaattaaggagagtcaagccctacccgtcgagaagctgtgaagagaagaacagccgagtacctcatgcgggcagaaagtatctctagtctttatgggaaacctcagcttgatgatgtatctcaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatga

SEQ ID NO: 14209 - DNA, 2499 bp, Artificial Sequence
  Synthetic polypeptide
ttaagcaaccactaccctgatcagtcggcagccagcaacataaaagcagtattccctctaacagcaaaaagattgcgacttactgaaggctcggatgatcgttgtcattttttagcaatatttttaaattaaggagagtcaagccctacccgtcgagaagctgtgaagagaagaacagccgagtacctcatgcgggcagaaagtatctctagtctttatgggaaacctcagcttgatgatgtatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcaatgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatga

SEQ ID NO: 14210 - DNA, 847 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14211 - DNA, 456 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctga

SEQ ID NO: 14212 - DNA, 883 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagtcagtcaccaaagggctaatactgacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14213 - DNA, 823 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14214 - DNA, 432 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctga

SEQ ID NO: 14215 - DNA, 859 bp, Artificial Sequence
  Synthetic polypeptide
ctattatttctaaaaaatacaaaataacaagtgttggcaagggtgtaaggaaacgaaacacttgtgtattaccaatgagagtgtaaagtggtgtagccactgtcaaaaacagcgtgcatttcctcagaaaattagacatagaattgtatgatctagcaattccacttctaagtatataaccaaaagaattggaggcagtgactcaaacatatatttgtatatctgtgttcatagtgacattattcacaatagccaagaggtagaagcaactcaagtgtccatcaacagatgaatggatgaacaaaatgtggtacagacataaaatggaatgtgattcagcctgaaaaaaacaagaaaattccaacacgttacaacagagatgaatcttgaagacattatgctgagtgaaataagacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14216 - DNA, 1002 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaagcccttggaaaagcacaagacataa

SEQ ID NO: 14217 - DNA, 1590 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14218 - DNA, 990 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggtataaaggtgaagaattga

SEQ ID NO: 14219 - DNA, 1431 bp, Artificial Sequence
  Synthetic polypeptide
tagtatgaaataataagaaatatacacattgatctctgtccccagttccaggaacagagctcctaaaatcctcataagtttctgagcagtaggggcactaggaggctcttttgttccaatatttggtgtctgccccagttcctccgacagagttcctaatacccttgtagataggggtactagaagaatcttttgttctatgatttggtctttgacccccattcttgtcacagagctccaaaatcccttggaatttcctgggtgataggagcatcttttattctgatgaggcgactcttagtgggctcctggatggtgctggtcaccagaaagaccaagccatgaccataaacttggagctttcagtcccagccctatccttcagggagggagaggggctggggattgagttaataattgaccatgcctctgtgatgaagcctccataaaaatccctaaatggtgttcagagagcatctgtgctggcaaactcatccaagtgctaggaaggtggtgcattcccactccgcggggacagaagctccagccctcaggacctttgcagactcgccttatgtatcttttcatctggctgttcatctgtatcctttatgatatccttcctaaccagtaaatgttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagagaaattcttcatgaaatattttctacggctagatcttaattcctataatagtacttggcaacatggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcatatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 14220 - DNA, 376 bp, Artificial Sequence; identical to SEQ ID NO: 10759
  Synthetic polypeptide

SEQ ID NO: 14221 - DNA, 83 bp, Artificial Sequence; identical to SEQ ID NO: 10925
  Synthetic polypeptide

SEQ ID NO: 14222 - DNA, 555 bp, Artificial Sequence; identical to SEQ ID NO: 10926
  Synthetic polypeptide

SEQ ID NO: 14223 - DNA, 74 bp, Artificial Sequence; identical to SEQ ID NO: 7010
  Synthetic polypeptide

SEQ ID NO: 14224 - DNA, 305 bp, Artificial Sequence; identical to SEQ ID NO: 6836
  Synthetic polypeptide

SEQ ID NO: 14225 - DNA, 423 bp, Artificial Sequence
  Synthetic polypeptide
gaagaaatctacaatgggagtcaagaaatacttgaaatggctgataatgaaaatgccacacattaagatttgtgcagtgcagctaaagtctggctctgagaaagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 14226 - DNA, 273 bp, Artificial Sequence
  Synthetic polypeptide
gaagaaatctacaatgggagtcaagaaatacttgaaatggctgataatgaaaatgccacacattaagatttgtgcagtgcagctaaagtctggctctgagaaagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaa

SEQ ID NO: 14227 - DNA, 325 bp, Artificial Sequence
  Synthetic polypeptide
ggccgggcacgatggctcaagcctgtaatcccagccctttgggaggctgaggcacgctgatcacctgaggtcaggagttcaagatcagcctggccaacatggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataa

SEQ ID NO: 14228 - DNA, 226 bp, Artificial Sequence
  Synthetic polypeptide
ggccgggcacgatggctcaagcctgtaatcccagccctttgggaggctgaggcacgctgatcacctgaggtcaggagttcaagatcagcctggccaacatggtgtttgtaaaatgtatgaagaacatctgaaaagaatgaatcccaacagtccctctatcacatatgacatcagtcagttgtttgatttcatcgatgatctggcagacctcagctgcctggtgtaa

SEQ ID NO: 14229 - DNA, 884 bp, Artificial Sequence
  Synthetic polypeptide
gaagagctttataaccagagcgttccaacaacgtatcagcgtgtcctggtacagctggaagctacttcttcctggaagagtttcactgaggattagaattacgtgtcaggatgggttgtctctataaggtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaa

SEQ ID NO: 14230 - DNA, 168 bp, Artificial Sequence
  Synthetic polypeptide
gaagagctttataaccagagcgttccaacaacgtatcagcgtgtcctggtacagctggaagctacttcttcctggaagagtttcactgaggattagaattacgtgtcaggatgggttgtctctataaggtgatctgcaactctttcaccatctgtaatgcggagatgc

SEQ ID NO: 14231 - DNA, 250 bp, Artificial Sequence; identical to SEQ ID NO: 6839
  Synthetic polypeptide

SEQ ID NO: 14232 - DNA, 1940 bp, Artificial Sequence
  Synthetic polypeptide
atggttaattttatgtgtcaagctgacttggtcatgggatgcccaggtaactggttaaacattatttctgggtgtctgcgtgtgagggtgtttttggaagagattaatgtttgaaaagactgtgtaatgctgattgccttcaatttgggcaatcggttgagagcctgaatagaacagaaaaggggaggaaggttgaatttgctctctgcctgactgtgtgagctggactttgatcctctcctgccctcagcactcctggttctcaggccttcagacctggactggaatctgttccatctgctctctagttctctggctctcaggactttgaaagctacaacaccagctttcctgggtctccagtctgtagatggcagattgtagagcttctcaccctccataattgtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 14233 - DNA, 1130 bp, Artificial Sequence
  Synthetic polypeptide
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14234 - DNA, 1031 bp, Artificial Sequence
  Synthetic polypeptide
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14235 - DNA, 1226 bp, Artificial Sequence
  Synthetic polypeptide
gctgggtgtggtggctcacgcctgtaatcccagcactttgggaggccgaggcaggcggatcaactgaggtcaggagttcgagaccagcctggccaacgtggtgaaaccctctctctactaaaaatacaaaaattagccaggattggtggtgggcacctgtaatcccagctactcgggagtctgagctgggcatggagcagcattatgaacttggagagtatataagaaagagatatagaaaattcttgaatgagtcctataaacatgaacaggtttatattcgaagcacagacgttgaccggactttgatgagtgctatgacaaacctggcagccctgtttcccccagaaggtgtcagcatctggaatcctatcctactctggcagcccatcccggtgcacacagttcctctttctgaagatcagttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 14236 - DNA, 811 bp, Artificial Sequence; identical to SEQ ID NO: 7106
  Synthetic polypeptide

SEQ ID NO: 14237 - DNA, 1040 bp, Artificial Sequence
  Synthetic polypeptide
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14238 - DNA, 1001 bp, Artificial Sequence
  Synthetic polypeptide
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14239 - DNA, 830 bp, Artificial Sequence
  Synthetic polypeptide
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggagctcgagtatatttagcttgccgggatgtggaaaagggggaattggtggccaaagagatccagaccacgacagggaaccagcaggtgttggtgcggaaactggacctgtctgatactaagtctattcgagcttttgctaagggcttcttagctgaggaaaagcacctccacgttttgatcaacaatgcaggagtgatgatgtgtccgtactcgaagacagcagatggctttgagatgcacataggagtcaaccacttgggctctggcgttacgacgtattctgtacaccctggcacagtccaatctgaactggttcggcactcatctttcatgagatggatgtggtggcttttctcctttttcatcaagactcctcagcagggagcccagaccagcctgcactgtgccttaacagaaggtcttgagattctaagtgggaatcatttcagtgactgtcatgtggcatgggtctctgcccaagctcgtaatgagactatagcaaggcggctgtgggacgtcagttgtgacctgctgggcctcccaatagactaa

SEQ ID NO: 14240 - DNA, 618 bp, Artificial Sequence
  Synthetic polypeptide
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagaggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaactggttcggcactcatctttcatgagatggatgtggtggcttttctcctttttcatcaagactcctcagcagggagcccaga

SEQ ID NO: 14241 - DNA, 643 bp, Artificial Sequence
  Synthetic polypeptide
ggctgggcttggtgactcacacctgtaatcccagcactttgggaggctgaggtgggcggatcacctgaggtcaggagttcgagaccatcctggccagcgtggtgaaaccctgtctctactaaaaatacaaaaattagctgggcgtggtggcgcatgggaaaatgctgtccagtggggtgtgtacatcaactgttcagcttcctgggaaagtagttgtggtcacaggagctaatacaggtatcgggaaggagacagccaaagagctggctcagagagaggaaaagcacctccacgttttgatcaacaatgcaggagtgatgatgtgtccgtactcgaagacagcagatggctttgagatgcacataggagtcaaccacttgggtcacttcctcctaacccatctgctgctagagaaactaaaggaatcagccccatcaaggatagtaaatgtgtcttccctcgcacatcacctgggaaggatccacttccataacctgcagggcgagaaattctacaatgcaggcctggcctactgtcacagcaagctagccaacatcctcttcacccaggaactggcccggagactaaaaggctctggcgttacgacgtattctgtacaccctggcacagtccaatctgaact

SEQ ID NO: 14242 - DNA, 634 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagtctggccttaccaaggcagtgaaggagagtacaattacattgcagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttga

SEQ ID NO: 14243 - DNA, 178 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaagtaaaagaggtgaggacgtatttctag

SEQ ID NO: 14244 - DNA, 589 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaagcaggcagagtatgaatttctgtcctttgtacgacagcagactcctccagggctctgtccacttgcaggaaattcagttcatgaagataagaagtttcttgacaaatacatgccccagttcatgaaacatcttcattatagaataattgatgtgagcactgttaaagaactgtgcagacgctggtatccagaagaatatgaatttgcaccaaagaaggctgcttctcatagggcacttgatgacattagtgaaagcatcaaagagcttcagttttaccgaaataacatcttcaagaaaaaaatagatgaaaagaagaggaaaattatagaaaatggggaaaatgagaagaccgtgagttga

SEQ ID NO: 14245 - DNA, 160 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggcacttga

SEQ ID NO: 14246 - DNA, 286 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaaggtcctaacctgattataaaacaaccagatgagttgctggacagcatgtcagattggtgtaaggagcatcacgggaaggaaattcagttcatgaagataagaagtttcttgacaaatacatgccccagttcatga

SEQ ID NO: 14247 - DNA, 208 bp, Artificial Sequence
  Synthetic polypeptide
tcagttttacttactttgcatctgtcccggagtagaatctcagtgcttgacaaatagcaggcccttgatgacaggattggacattgagaaggaccagattattgagatggcctgtctgataactgactctgatctcaacattttggctgaagaaattcagttcatgaagataagaagtttcttgacaaatacatgccccagttcatga

SEQ ID NO: 14248 - DNA, 810 bp, Artificial Sequence
  Synthetic polypeptide
ctgcatcctgccagacctacccatacagacatcaaagtaatgattattgcttattgcctgacctaggatgtgagctccatgagaacagagactgtttacctctcgctcccctgcacctaaaacaatgcctgcttggtgtaaaggcaagccaagtctttgaagactgaagacttgctggcaatggtgataaagctgcagaaagagggaagcctggagccacagatagaggacctgattagccggattaatgatcttcagcaagcaaagaagaaatccagtgaggaactgagagagacccacagtctctgggaggccctgcatagggaattagactccttgaatggagagaaagtgcacctagaggaggtcttgggcaaaaagcaagaggcactgaggatcctccagatgcactgccaagagaaggaaagcgaggctcagaggttggatgtcagaggacagctggaggatctgatgggccagcacaaggacctctgggaattccacatgctggagcagcgactggcccgggagatccgtgccctggagagaagcaaggagcagctgctctcggagaggaggctggtgcgcgccaagctgcgggaggtggagcggcggctgcactcgccgcctgaggtcgagggcgccatggcggtgaatgacgggctgaaggcggagctggagatattcggggagcaggtccggagcgcccccgaggtcggggccggcgagggagaggccggacctgagctcccccgcgctcgcgacgaggaggatcccgagccgccggtggctgcccctgacgccctctag

SEQ ID NO: 14249 - DNA, 531 bp, Artificial Sequence
  Synthetic polypeptide
ggagccctccttatggacctggagaccccagaggagatgcaggctcggagcctgggcaggcccatcaaatcctcaaagcagtacctgcggcaggtcattgcagagtacgaggcactggaccgagaactcccgtgcatccggaagttccccacaccaccagcttcccagcccctctgcctctgcatggagaccttgcccgaggaggattttacccacctggaggtgctgcaagccctggaggcccagttaccaggggccatggagagcgggcgcgtgagcagcatccgctttgagaacatgaacgtcatctgtgggactgctgggcgccggaaccggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctga

SEQ ID NO: 14250 - DNA, 555 bp, Artificial Sequence
  Synthetic polypeptide
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14251 - DNA, 525 bp, Artificial Sequence
  Synthetic polypeptide
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14252 - DNA, 528 bp, Artificial Sequence
  Synthetic polypeptide
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14253 - DNA, 525 bp, Artificial Sequence
  Synthetic polypeptide
tccgtgaatcctctaaagtatatgcaaaatttcgcgtgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14254 - DNA, 533 bp, Artificial Sequence
  Synthetic polypeptide
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14255 - DNA, 503 bp, Artificial Sequence
  Synthetic polypeptide
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14256 - DNA, 506 bp, Artificial Sequence
  Synthetic polypeptide
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14257 - DNA, 503 bp, Artificial Sequence
  Synthetic polypeptide
tccgtgaatcctctaaagaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14258 - DNA, 812 bp, Artificial Sequence; identical to SEQ ID NO: 693
  Synthetic polypeptide

SEQ ID NO: 14259 - DNA, 752 bp, Artificial Sequence; identical to SEQ ID NO: 694
  Synthetic polypeptide

SEQ ID NO: 14260 - DNA, 806 bp, Artificial Sequence
  Synthetic polypeptide
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaaggtactgaagacagtacagattag

SEQ ID NO: 14261 - DNA, 228 bp, Artificial Sequence
  Synthetic polypeptide
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaacttt

SEQ ID NO: 14262 - DNA, 902 bp, Artificial Sequence
  Synthetic polypeptide
ggtcaggtgcggtggctcatgcctgtaatcccagcactttggaaggctgaggcgggcagatcacctgaggtcaggagttcgagaccagcctggctaacatgttgctatacctgcctttcaggaactgccctcgttttcaagaacttgagagtgagactttgaaatcagaggaattccagaagaggctgcacccttataaggattttatagctaccttgggaaaactttcaggattacatggccaggacctttttggaatttggagtaaagtctacgaccctttatattgtgagagtgttcacaatttcactttaccctcctgggccactgaggacaccatgactaagttgagagaattgtcagaattgtccctcctgtccctctatggaattcacaagcagaaagagaaatctaggctccaagggggtgtcctggtcaatgaaatcctcaatcacatgaagagagcaactcagataccaagctacaaaaaactcatcatgtattctgcgcatgacactactgtgagtggcctacagatggcgctagatgtttacaacggactccttcctccctatgcttcttgccacttgacggaattgtactttgagaagggggagtactttgtggagatgtactatcggaatgagacgcagcacgagccgtatcccctcatgctacctggctgcagccccagctgtcctctggagaggtttgctgagctggttggccctgtgatccctcaagactggtccacggagtgtatgaccacaaacagccatcaagttctaaaggtcatctttgctgttgccttttgcctgatatctgctgtcctaatggtactactgtttatccacattcgccgtggactctgctggcagagagaatcctatgggaacatctga

SEQ ID NO: 14263 - DNA, 515 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14264 - DNA, 726 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14265 - DNA, 213 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 14266 - DNA, 568 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14267 - DNA, 528 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14268 - DNA, 624 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14269 - DNA, 315 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14270 - DNA, 597 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14271 - DNA, 657 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14272 - DNA, 744 bp, Artificial Sequence
  Synthetic polypeptide
tgtttcagggcgctgggtctggatccagacagcatgggtgcagatctctgttccactacttactattttgggagaccctgggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14273 - DNA, 433 bp, Artificial Sequence
  Synthetic polypeptide
ggccaggcacagtggctcacgcctgtaatcccagcactttatgaatcccagcattcattagacgaggctgaggcaggtggatcccttgagcctaggagtttgagaccagcctgggcaacatggccctggtatgcgtccaccactaggcttaagagaatttgcaccaggcgttccaccaggaagacgggacctgcctctccaccctcggggatttttacctggacacgcaccatttagacctttaggttcacttggcccaagagagtactttattcctggtacccgattaccacccccaacccatggtccccaggaatacccaccaccacctgctgtaagagacttactgccgtcaggctctagagatgagcctccacctgcctctcagagcactagccaggactgttcacaggctttaaaacagagcccataa

SEQ ID NO: 14274 - DNA, 352 bp, Artificial Sequence
  Synthetic polypeptide
caggggacattggcattatctggagacatttttgattgtctggggaaggggcagggagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaagggccaaactttag

SEQ ID NO: 14275 - DNA, 436 bp, Artificial Sequence
  Synthetic polypeptide
caggggacattggcattatctggagacatttttgattgtctggggaaggggcagggagaatgctaacaaattagaagaaagtgccagagaacaccacataccttgtccggaacattacaatggcttctgcatgcatgggaagtgtgagcattctatcaatatgcaggagccatcttgcaggtgtgatgctggttatactggacaacactgtgaaaaaaaggactacagtgttctatacgttgttcccggtcctgtacgatttcagtatgtcttaatcgcagctgtgattggaacaattcagattgctgtcatctgtgtggtggtcctctgcatcacaaggaaatgccccagaagcaacagaattcacagacagaagcaaaatacagggcactacagttcagacaatacaacaagagcgtccacgaggttaatctaa

SEQ ID NO: 14276 - DNA, 1389 bp, Artificial Sequence; identical to SEQ ID NO: 863
  Synthetic polypeptide

SEQ ID NO: 14277 - DNA, 1244 bp, Artificial Sequence
  Synthetic polypeptide
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagttactttgacgagccagtggagttaaggagcagttctttctctagctgggatgacagttcagattcctattggaaaaaagagaccagcaaagatactgaaacagttctgaaaaccacaggctattcagacagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagcagggaactacagcctgtccagtgtgctgcccaacgcccccgacatggcgcagttcaagcagggagtgagatcggttgctggaaaactctccgtctttgctaatggagtcgtgacttcaattcaggatcgctacggttcttaa

SEQ ID NO: 14278 - DNA, 971 bp, Artificial Sequence
  Synthetic polypeptide
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggccttggggccaaaaaaggaagtttgggagctcagaaactggcaaacacatgctttaatgaaattgaaaaacaagctcaagctgcggataaaatgaaggagcaggaagacctggccaaggtggtatctaaagaagaatcaattgtttcatcattacgattagcctataaggatcttgaaattcaaatgaagaaagacgaaaagatgaacattagtggcaaaaaaaatgttgactcagacagactcggcatgggatttggaaattgcagaagtgttatttcacattcagtgacttcagatatgcagaccatagagcaggaatcacccattatggcaaaaccaagaaaaaagtataatgatgacagtgacgattcatattttacttccagctcaagacctactgctcgccgcaagccagattatgagccagttgaaaatacagatgaggcccagaagaagtttggcaatgtcaaggccatttcatcagatatgtattttggaagacaatcccaggctgattatgagaccagggcccgcctagagaggctgtcggcaagttcctccataagctcggctgatctgttcgaggagccgaggaagcagccagca

SEQ ID NO: 14279 - DNA, 365 bp, Artificial Sequence
  Synthetic polypeptide
ggccgggttcagtggctcacgcctgtaatcctggcacttcgggaggccaaggcgggtggaccacctgaggtcaggaatttgagaccagcctgaccaacatggagaaaccccatctctactaaaaatacaaaattagccgggcatggtggcgcatgcctgtaatcccagctactcgggtggccgaggcaggataatggcttgaacccgggaggcgaaggttgcagtgagccgagatcgtgccattgcactccagcttgggtggacaagagcaaggaccaagtgtggaaggtcttaatgtaccaacaaaggctactttagaggtatcctctatcataaaaaagaaaccaaatcaagctaaaaaaggc

SEQ ID NO: 14280 - DNA, 607 bp, Artificial Sequence
  Synthetic polypeptide
cagaaataaagagaagatcctaaaatcagctagagaagtaaaacagatcacctatcaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctga

SEQ ID NO: 14281 - DNA, 2414 bp, Artificial Sequence
  Synthetic polypeptide
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14282 - DNA, 2321 bp, Artificial Sequence
  Synthetic polypeptide
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccaggtactgtaaaatctgaggcaactagcgattggagtcgaccccccagcacaacacagcagccctgcagaaaagtggctagactgtttaaaaaaaaaaaaaagaaaagaaaaaaaaggacaagctccactcaaaggtcaccaacctcaaagattgaaggcagataagcccacaaagatgagaaaggatcagtacaagaacattgaaaactcaaaatgccacagtgccctctttcctccaaatgactgcatcacttctccagcaaggtttcggaaccgggttgaggctgagatgcctgaaatgacagaagtagaattcataatatggatagggacaaagtttactgagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14283 - DNA, 1514 bp, Artificial Sequence
  Synthetic polypeptide
tgaagtcaaacagtcctggctatgaatctcagctctgccatttaccaattgtgtgactttggacaagttattttgcttttgagtttccttatcctcgaaaaaagggtgtcatcgtaacttcctgggactgttgtaggaattacacaagacagtgtgcagtagatgcctagtgtgttgggaatacccagtaaatggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactga

SEQ ID NO: 14284 - DNA, 1257 bp, Artificial Sequence; identical to SEQ ID NO: 625
  Synthetic polypeptide

SEQ ID NO: 14285 - DNA, 1215 bp, Artificial Sequence; identical to SEQ ID NO: 626
  Synthetic polypeptide

SEQ ID NO: 14286 - DNA, 507 bp, Artificial Sequence; identical to SEQ ID NO: 628
  Synthetic polypeptide

SEQ ID NO: 14287 - DNA, 313 bp, Artificial Sequence; identical to SEQ ID NO: 629
  Synthetic polypeptide

SEQ ID NO: 14288 - DNA, 291 bp, Artificial Sequence; identical to SEQ ID NO: 630
  Synthetic polypeptide

SEQ ID NO: 14289 - DNA, 84 bp, Artificial Sequence
  Synthetic polypeptide
gtgttatttgtggggtacagagatgaaagaggggtggtgcattaccggaagtggatcaaggacaccatcgcagccaacccctga

SEQ ID NO: 14290 - DNA, 130 bp, Artificial Sequence
  Synthetic polypeptide
gtgttatttgtggggtacagagatgaaagaggggtggtgcattaccggaagtggatcaaggacaccatcgcagccaacccctgagtgcccctgtcccacccctacctctagtaaatttaagtccacctca

SEQ ID NO: 14291 - DNA, 1118 bp, Artificial Sequence
  Synthetic polypeptide
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctga

SEQ ID NO: 14292 - DNA, 959 bp, Artificial Sequence
  Synthetic polypeptide
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctga

SEQ ID NO: 14293 - DNA, 674 bp, Artificial Sequence
  Synthetic polypeptide
ctgggagtggggaatgcatgcttgggccctactctacacggactgaatcacagttggtggagggggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggta

SEQ ID NO: 14294 - DNA, 438 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggt

SEQ ID NO: 14295 - DNA, 649 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14296 - DNA, 136 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggccaggtga

SEQ ID NO: 14297 - DNA, 491 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgct

SEQ ID NO: 14298 - DNA, 547 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14299 - DNA, 238 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14300 - DNA, 580 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14301 - DNA, 667 bp, Artificial Sequence
  Synthetic polypeptide
ggctgggcgcggtggctcacacctgtaatcccagcactttgggaggccaaggcaggtagatcacctgagcaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14302 - DNA, 2157 bp, Artificial Sequence
  Synthetic polypeptide
ggccgggagcggtggctcacacctgtaatcccagcactttgggaggccaaggcaggcggatcacgagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 14303 - DNA, 1970 bp, Artificial Sequence
  Synthetic polypeptide
ggccgggagcggtggctcacacctgtaatcccagcactttgggaggccaaggcaggcggatcacgagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaagga

SEQ ID NO: 14304 - DNA, 1518 bp, Artificial Sequence
  Synthetic polypeptide
taatgaccttgaattccaagaagaggtaaaaataatgtttaataaaagttgtttcagaagcagtggaatataataaatatcaaatgtgttttcagtgataatggtgaaggtaaaaaagtgttgatgcataaaaggatgtgtatcagtcagctggaaaattcagaacgtatcaatgagtgtgatgagatatgcctttcagttttgtcaactgttttagaggcaatggaaccatgcaagaatgttcatgttctacgaacgggattcagaatactagttgatcagcaagtttggaaaatagaagatgtcttcacattacaagttgtgatgaagtgtattggaaaagatgcaccgattgctcttaagaggaaactggagatgaaagccttgagggaattagacagattttctgttttgaatagccaacacatgtttgaagtactagctgccatgaatcaccgatctcttatactcctggatgaatgcagtaaggtggtcctagataatatccatgggtgtcctttaagaataatgatcaacatattgcagtcctgcaaagacctccagtaccataatttggatctcttcaagggacttgcagattatgtggctgcaactttcgacatctggaagttcagaaaagttctttttatcctcattttatttgaaaaccttggctttcgacctgttggtttaatggacctgtttatgaagagaatagtagaggatcctgaatccctaaacatgaaaaacattctatctattcttcatacttactcttctctcaatcatgtctacaaatgccagaacaaagaacagttcgtggaagttatggctagtgctctgactggttatcttcacactatttcttctgaaaacttattggatgcagtatattcattttgcttgatgaattactttcccctggctccttttaatcagcttctgcaaaaagacatcatcagtgagctgctgacatcagatgacatgaagaatgcttacaagctgcatactttggatacttgtctaaaacttgatgatactgtctatctgagggacatagccttgtcactcccacagctgccgcgggagctgccatcgtcacatacaaatgcaaaggtggcagaggtgctgagcagccttctgggaggtgaaggacacttctcaaaggatgtgcacttgccacacaattatcatattgattttgaaatcagaatggacactaacaggaatcaagtgctaccactttctgatgtggatacaacttctgctacagatattcaaagagtagctgtgctatgtgtttccagatctgcttattgtttgggttcaagccaccccagaggattccttgctatgaaaatgcggcatttgaatgcaatgggttttcatgtgatcttggtcaataactgggagatggacaaactagagatggaagatgcagtcacatttttgaagactaaaatctattcagtagaagctcttcctgttgctgctgtaaatgtgcaaagcacacaataa

SEQ ID NO: 14305 - DNA, 3502 bp, Artificial Sequence
  Synthetic polypeptide
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatgttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14306 - DNA, 3643 bp, Artificial Sequence
  Synthetic polypeptide
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14307 - DNA, 2245 bp, Artificial Sequence
  Synthetic polypeptide
ggctgggcacgttggttcacacctataatcccagtactttgcaaggccaaggcaggtggatcacttgaggtcaggatttcgagaccagcctgatcaacatggtgaaaccccgtctctactaaaactaaaaaaaaaaaaaaaaattagccaggcatgatggcgcatgcctgtaatcccagctacttgggaggctaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctag

SEQ ID NO: 14308 - DNA, 1177 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14309 - DNA, 625 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 14310 - DNA, 441 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 14311 - DNA, 718 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 14312 - DNA, 1213 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14313 - DNA, 1132 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14314 - DNA, 895 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 14315 - DNA, 811 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 14316 - DNA, 874 bp, Artificial Sequence
  Synthetic polypeptide
ctgatttctcttaagatttttatcaagacaatatgtgcacagctgaacatagacccttatcaggagtttttgattttgccttttgccttgtgatctttattggcctcagaagcatgtgatctttgttcttcttgtttgccctttgaagcatgtgatctttgtgacctactccctgttcttaaacctcctccccttttgaaatccttaataaaaacttgctggttttgcggctcaggtgggcatcacggacctaccaatatgtgatgtcacccctggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 14317 - DNA, 3156 bp, Artificial Sequence
  Synthetic polypeptide
ggtggcacatgcctgtaatcccagccactcaggaggctgagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 14318 - DNA, 3360 bp, Artificial Sequence
  Synthetic polypeptide
ggtggcacatgcctgtaatcccagccactcaggaggctgagatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 14319 - DNA, 1433 bp, Artificial Sequence
  Synthetic polypeptide
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctactgttgaggctattgaggctgatgaagctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14320 - DNA, 1277 bp, Artificial Sequence
  Synthetic polypeptide
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14321 - DNA, 1403 bp, Artificial Sequence
  Synthetic polypeptide
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgtgtgcatggtggtttgtctccagagattaacactttagatgatatcagaaaattagaccgattcaaagaaccacctgcatatggacctatgtgtgatatcctgtggtcagaccccctggaagattttggaaatgagaagactcaggaacatttcactcacaacacagtcagggggtgttcatacttctacagttacccggctgtatgtgaattcttacagcacaataacttgttatctatactccgagcccacgaagcccaagatgcagggtaccgcatgtacaggaaaagccaaacaacaggcttcccttctctaattacaattttttcagcaccaaattacttagatgtatacaataacaaagctgcagtattgaagtatgagaacaatgttatgaatatcaggcaattcaactgttctcctcatccatactggcttccaaatttcatggatgtttttacttggtcccttccatttgttggggaaaaagtgactgagatgctggtaaatgtcctcaacatctgctcagatgatgaactagggtcagaagaagatggatttgatggtgcaacagctgcagcccggaaagaggtgataaggaacaagatccgagcaataggcaaaatggccagagtgttctcagtgctcagagaagagagtgagagtgtgctgacgctgaaaggcttgaccccaactggcatgctccccagcggagtactttctggagggaagcaaaccctgcaaagcgctatcaaaggattttcaccacaacataagatcactagcttcgaggaagccaagggcttagaccgaattaatgagaggatgccgcctcgcagagatgccatgccctctgacgccaaccttaactccatcaacaaggctctcacctcagagactaacggcacggacagcaatggcagtaatagcagcaatattcagtga

SEQ ID NO: 14322 - DNA, 458 bp, Artificial Sequence
  Synthetic polypeptide
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgcctttgactgccttcccctggctgccctgatgaaccaacagttcctgtgt

SEQ ID NO: 14323 - DNA, 413 bp, Artificial Sequence
  Synthetic polypeptide
gggccctgcggccagactgccaggattggttcacatcttggctgactgtataacttgctaccttaagaattttggccacttacctaaaactcgctgagcctcagtttcctcgtctgcataatggagtttgtggggacattcatggacaattctttgatttgatgaagctctttgaagtcgggggatctcctgccaacactcgctacctcttcttaggggactatgttgacagagggtacttcagtattgaatgtgtgctgtatttgtgggccttgaaaattctctaccccaaaacactgtttttacttcgtggaaatcatgaatgtagacatctaacagagtatttcacatttaaacaagaatgtaaaataaagtattcagaacgcgtatatgatgcctgtatggatgccttt

SEQ ID NO: 14324 - DNA, 2069 bp, Artificial Sequence
  Synthetic polypeptide
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14325 - DNA, 1976 bp, Artificial Sequence
  Synthetic polypeptide
ggaggagtgaccaagatgactgactagaagcaactatggtgtgtggctctcacaaagagaaattgaaggggcaagtaaatacagcaccttcaactgaaacgagcagatactcacattgggactaatcaaggaaacaacccaacccaaggagaatggagaaaagcaaggcaggacgatggcccacctgggaatgacacagagtcaagggaacctcccccacccaggaaaatgatgagcgaatgtgcaaccccaggaaaccatgctttttccatggatctttgcaacgcttaggtcagcagatacccttgtgaacccactccaccagggccttcagtctgatacacaggtgcatggagtcttagcagaacagccactcaggcatgcacagagacacaggagctttagatacaccagctttccaggcttcatggcaaaagtaactgcaactccagcacagcaggaggttagacccccatacatacccataaaaaagaggctgaattcaagggcctgagcagtgatggtctgcaggccccacttccacagcacttcacaggataagacccactggcttggatttccagccagccactggtagcagtgttgtgcctatctgggaaagagctcttgggtggtggtggggggcagggaggtgggggtggaggggtgggctgccatctttgctgtttgggtggcttagccattcccacctttaggctttggagagcccaagatgactgggggtggaagcggtaccccagcacagcacagtggcctcacaaaaacgtggccagacttccttataaagcagatccccaactacgttcctcatcaatgggtggagcctcccaactagggtttctggctacccccactggtgttctctggctaacagaggttttaggacaccctgggatggagctgccaggaggaggggcaaaccaccatctttgctgtttgggtgacttagccatcccaggtttcagacttcggagtgtccaagacaaccgagggctgaagtggaccctcaccacagcacagttgctctacaaaaacgtggccaggctactttttaaactgggtccctgatccttttcctcctgtctgggtaagacctcctagtggggtctccagccacctcctacaggtctgttcaggctggcaacatgtctataactcccttggacggaggtcctacagtaagaagcaggctgcattctttactgtttcacagccatcaccgatgattcctccagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14326 - DNA, 414 bp, Artificial Sequence; identical to SEQ ID NO: 602
  Synthetic polypeptide

SEQ ID NO: 14327 - DNA, 434 bp, Artificial Sequence; identical to SEQ ID NO: 603
  Synthetic polypeptide

SEQ ID NO: 14328 - DNA, 560 bp, Artificial Sequence
  Synthetic polypeptide
aaaataccaaggcccagtctctatcagtgtatttacattagaattttgggggatgggacctcatagggtttctttgtttgtttgttttaaagggctccagctgattataaagccaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctga

SEQ ID NO: 14329 - DNA, 1375 bp, Artificial Sequence
  Synthetic polypeptide
tagaccataaggccctattctgactgcttcccctgtaggctctgatctctctttccacctctcttccctttattcactccactctaacaactctggtctctgctgttcccatgttccagggatggctctgcctcagggtctgtgccttggctattccttcagcctaggacatccttccctgtggcttgctctatcacctccttcaggtctttgctcaaatggtaattcctcaatgagaccttccggggtgggtcttcacaccattttaaactctcagcacttccattctccctcccttgtcctacttttccttctttcttcacagttcttatgaactcctaacacactggataatctacaaatgtattatgtacattgtttatgcttaatctccctgatttagaagaaaaggtgtgagcggtactgggcccaggagcaggagccactgcagactgggcttttctgcatcactctgataaaggagaagtggctgaatgaggacatcatgctcaggaccctcaaggtcacattccagaaggagtcccgttctgtgtaccagctacagtatatgtcctggccagaccgtggggtccccagcagtcctgaccacatgctcgccatggtggaggaagcccgtcgcctccagggatctggccctgaacccctctgtgtccactgcagtgcgggttgtgggcgaacaggcgtcctgtgcaccgtggattatgtgaggcagctgctcctgacccagatgatcccacctgacttcagtctctttgatgtggtccttaagatgaggaagcagcggcctgcggccgtgcagacagaggagcagtacaggttcctgtaccacacggtggctcagatgttctgctccacactccagaatgccagcccccactaccagaacatcaaagagaattgtgccccactctacgacgatgccctcttcctccggactccccaggcacttctcgccataccccgcccaccaggaggggtcctcaggagcatctctgtgcccgggtccccgggccacgccatggctgacacctacgcggtggtgcagaagcgcggggctccagcgggcgccgggagtgggacgcagacggggacggggacggggacgggggcgcgcagcgcggaggaggcgccgctctacagcaaggtgacgccgcgcgcccagcgacccggggcgcacgcggaggacgcgagggggacgctgcctggccgcgttcctgctgaccaaagtcctgccggatctggcgcctacgaggacgtggcgggtggagctcagaccggtgggctaggtttcaacctgcgcattgggaggccgaagggtccccgggacccgcctgctgagtggacccgggtgtaa

SEQ ID NO: 14330 - DNA, 455 bp, Artificial Sequence
  Synthetic polypeptide
gctgggtgtggtggctcatgcctgtaatcccagcactttgggaggctgaggtgggtggatcacctgaggtcaggagtttgagaccagcctggccaacacagtgaaacatcgtccctactaaaaatacagacaattacctgggagtggtgctttatcttcaagccaggatgaagggagactgggcaagactcttacgccccacactgcaatttggtcttgttgccgtatccatttatgtgggcctttctcgagtttctgattataaacaccactggagcgatgtgttgactggactcattcagggagctctggttgcaatattagttgctgtatatgtatcggatttcttcaaagaaagaacttcttttaaagaaagaaaagaggaggactctcatacaactctgcatgaaacaccaacaactgggaatcactatccgagcaatcaccagccttga

SEQ ID NO: 14331 - DNA, 2249 bp, Artificial Sequence
  Synthetic polypeptide
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaacccaatagtattaagaatgatgaatgatcaactcatgtttctggaaagagcatttattgatccattagggttaccagacaggcctttttataggcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14332 - DNA, 2156 bp, Artificial Sequence
  Synthetic polypeptide
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttatataattttacacagataccacatttagcaggaacagaacaaaactttcagcttgcaaagcaaattcaatcccagtggaaagaatttggcctggattctgttgagctagcacattatgatgtcctgttgtcctacccaaataagactcatcccaactacatctcaataattaatgaagatggaaatgagattttcaacacatcattatttgaaccacctcctccaggatatgaaaatgtttcggatattgtaccacctttcagtgctttctctcctcaaggaatgccagagggcgatctagtgtatgttaactatgcacgaactgaagacttctttaaattggaacgggacatgaaaatcaattgctctgggaaaattgtaattgccagatatgggaaagttttcagaggaaataaggttaaaaatgcccagctggcaggggccaaaggagtcattctctactccgaccctgctgactactttgctcctggggtgaagtcctatccagatggttggaatcttcctggaggtggtgtccagcgtggaaatatcctaaatctgaatggtgcaggagaccctctcacaccaggttacccagcaaatgaatatgcttataggcgtggaattgcagaggctgttggtcttccaagtattcctgttcatccaattggatactatgatgcacagaagctcctagaaaaaatgggtggctcagcaccaccagatagcagctggagaggaagtctcaaagtgccctacaatgttggacctggctttactggaaacttttctacacaaaaagtcaagatgcacatccactctaccaatgaagtgacaagaatttacaatgtgataggtactctcagaggagcagtggaaccagacagatatgtcattctgggaggtcaccgggactcatgggtgtttggtggtattgaccctcagagtggagcagctgttgttcatgaaattgtgaggagctttggaacactgaaaaaggaagggtggagacctagaagaacaattttgtttgcaagctgggatgcagaagaatttggtcttcttggttctactgagtgggcagaggagaattcaagactccttcaagagcgtggcgtggcttatattaatgctgactcatctatagaaggaaactacactctgagagttgattgtacaccgctgatgtacagcttggtacacaacctaacaaaagagctgaaaagccctgatgaaggctttgaaggcaaatctctttatgaaagttggactaaaaaaagtccttccccagagttcagtggcatgcccaggataagcaaattgggatctggaaatgattttgaggtgttcttccaacgacttggaattgcttcaggcagagcacggtatactaaaaattgggaaacaaacaaattcagcggctatccactgtatcacagtgtctatgaaacatatgagttggtggaaaagttttatgatccaatgtttaaatatcacctcactgtggcccaggttcgaggagggatggtgtttgagctagccaattccatagtgctcccttttgattgtcgagattatgctgtagttttaagaaagtatgctgacaaaatctacagtatttctatgaaacatccacaggaaatgaagacatacagtgtatcatttgattcacttttttctgcagtaaagaattttacagaaattgcttccaagttcagtgagagactccaggactttgacaaaagcaagcatgtcatctatgctccaagcagccacaacaagtatgcaggggagtcattcccaggaatttatgatgctctgtttgatattgaaagcaaagtggacccttccaaggcctggggagaagtgaagagacagatttatgttgcagccttcacagtgcaggcagctgcagagactttgagtgaagtagcctaa

SEQ ID NO: 14333 - DNA, 221 bp, Artificial Sequence
  Synthetic polypeptide
taaattccagttttgactttgccacttcttagtggccttgaacaagttaccgagtccctctcagcgttagttaccctattttatgatgaggataatattatctgcaaattattgggtggtttataaaatcctccaatgaagctactaacattactccaaagcataatatgaaagcatttttggatgaattgaaagctgagaacatcaagaagttcttataa

SEQ ID NO: 14334 - DNA, 343 bp, Artificial Sequence
  Synthetic polypeptide
ctccaccaccatttctacgtgtctaagtctgtccattcctcaaggcccagtttgctattttctcctccctgaagctcctcctcagaaattttggccagaggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14335 - DNA, 1139 bp, Artificial Sequence
  Synthetic polypeptide
aactatgctgctataaagacacatgcacacgtatgtttattgcggcactattcacaatagcaaagacttggaaccaacccaaatgtccaacaatgatagattggattaagaaaatgtggcacatatacaccatggaatactatgcagccataaaaaatgatgagttcatgtcctttgtagggacatggatgaagctggaaaccatcattctcagcaaactatcccaaggacaaaaaacagaacaccgcatgttctcactcatagccgattacaaggagagctttaatacgattggaaacattgaagagattgcatataatgctgtttcctttacctgggacgtgaatgaagaggcgaagattttcatcaccgtgaattgcttgagcacagatttctcctcccaaaaaggggtgaaaggacttcctttgatgattcagattgacacatacagttataacaatcgtagcaataaacccattcatagagcttattgccagatcaaggtcttctgtgacaaaggagcagaaagaaaaatccgagatgaagagcggaagcagaacaggaagaaagggaaaggccaggcctcccaaactcaatgcaacagctcctctgatgggaagttggctgccatacctttacagaagaagagtgacatcacctacttcaaaaccatgcctgatctccactcacagccagttctcttcatacctgatgttcactttgcaaacctgcagaggaccggacaggtgtattacaacacggatgatgaacgagaaggtggcagtgtccttgttaaacggatgttccggcccatggaagaggagtttggtccagtgccttcaaagcagatgaaagaagaagggacaaagcgagtgctcttgtacgtgaggaaggagactgacgatgtgttcgatgcattgatgttgaagtctcccacagtgaagggcctgatggaagcgatatctgagaaatatgggctgcccgtggagaagatagcaaagctttacaagaaaagcaaaaaaggcatcttggtgaacatggatgacaacatcatcgagcactactcgaacgaggacaccttcatcctcaacatggagagcatggtggagggcttcaaggtcacgctcatggaaatctag

SEQ ID NO: 14336 - DNA, 648 bp, Artificial Sequence
  Synthetic polypeptide
acgcacgcacacacacacacggtgaaacacagacacacacggcttgaaggagagcaaggagaagatggatggagagatagaaaccgagggagggagagagacagcgatcgagagagaccggagaggtggagagcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatga

SEQ ID NO: 14337 - DNA, 164 bp, Artificial Sequence; identical to SEQ ID NO: 831
  Synthetic polypeptide

SEQ ID NO: 14338 - DNA, 193 bp, Artificial Sequence; identical to SEQ ID NO: 834
  Synthetic polypeptide

SEQ ID NO: 14339 - DNA, 560 bp, Artificial Sequence
  Synthetic polypeptide
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaagttggaaaggctggtggatgtactgaggaagaaggttggaaccgggaccatgaggacagtgatctga

SEQ ID NO: 14340 - DNA, 599 bp, Artificial Sequence
  Synthetic polypeptide
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaactatacccttagtacatatgaagaagctttaaaaaacagagagaacattgtttccatcactcaacaacaaaatgaggaactggctactcaactgcaacaagctctgacagagcgagcaaatatggaattacaacttcaacatgccagagaggcctcccaagtggccaatgaaaaagttcaaaaatctcaaatacaaatctatttcattccaaataaaaaagatgaaagagaaaaattcctaatggataaaagaagaaagattgttgcacattcaaaacagaattcttga

SEQ ID NO: 14341 - DNA, 310 bp, Artificial Sequence
  Synthetic polypeptide
tatatagtgtaaatgcacacttaccacaggactcagcaatttcactcttaggtatttacccaagagaaacaaagttatatttccacaaaaatgacctctatgtcgatatttatagcagctttattagtaattgccaaagaactagaaatcagccaaatgtctaacaggcaaagttgttatctatgcaacaagccagagaaactgcagttcaacagtacaaaaaactggaagaggaaatccagacccttcgagtttactacagtttacacaaatctttatctcaagaagaaaatctgaaggatcagtttaa

SEQ ID NO: 14342 - DNA, 1433 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttag

SEQ ID NO: 14343 - DNA, 1070 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgattcttgctccgtcacccatgctcgagtgcagtggcgtgatctcggcacactgcagcctctgcttcctgggttcaagtga

SEQ ID NO: 14344 - DNA, 551 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttag

SEQ ID NO: 14345 - DNA, 884 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttga

SEQ ID NO: 14346 - DNA, 1070 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctga

SEQ ID NO: 14347 - DNA, 470 bp, Artificial Sequence
  Synthetic polypeptide
tgatatggtttggctgtgtcctcaccccagtctcatcttgaattgtaattctcataatccccatgtgttgtggggtggagcaggtggagataattgaatcatgggtgtggtttcctccatcctgttctcgtgatagtgagttctgatggttttataagtgggagttcttctgcacaaactctctcgcctgctgtcatgtaagatgtgactttgctcctcattcgccttctgccatgattgtgaggcctccccagccctgtgaaactgaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccgg

SEQ ID NO: 14348 - DNA, 576 bp, Artificial Sequence
  Synthetic polypeptide
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttga

SEQ ID NO: 14349 - DNA, 546 bp, Artificial Sequence
  Synthetic polypeptide
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcagtgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtaa

SEQ ID NO: 14350 - DNA, 252 bp, Artificial Sequence
  Synthetic polypeptide
aggcagaatatcagttgactagagcggcatactagaaatcaggaaattcaacttctggccttggctggaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatag

SEQ ID NO: 14351 - DNA, 943 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14352 - DNA, 391 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctga

SEQ ID NO: 14353 - DNA, 207 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaa

SEQ ID NO: 14354 - DNA, 484 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaagatctttgataccatactttaatctgtatcttcagtttctgaacataagtatgcaaaatctttttaaggtgcatactctgctgcgtccctgctattttctaggacaaaaataa

SEQ ID NO: 14355 - DNA, 979 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataa

SEQ ID NO: 14356 - DNA, 898 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatgaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaa

SEQ ID NO: 14357 - DNA, 661 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaa

SEQ ID NO: 14358 - DNA, 577 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggctgctgggggatgcttcagtttccttcacagaaaactaaatag

SEQ ID NO: 14359 - DNA, 640 bp, Artificial Sequence
  Synthetic polypeptide
agacttccccctttcagagcggcagacgctggcatacacaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataa

SEQ ID NO: 14360 - DNA, 3067 bp, Artificial Sequence
  Synthetic polypeptide
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14361 - DNA, 3064 bp, Artificial Sequence
  Synthetic polypeptide
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14362 - DNA, 3100 bp, Artificial Sequence
  Synthetic polypeptide
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactga

SEQ ID NO: 14363 - DNA, 2236 bp, Artificial Sequence
  Synthetic polypeptide
tgatatggtttggctctgtgtccccatccaaatctcatcttgaattgtaatccccacgtgttgagggagggacctatgatccccatgtgtcaagggaggcaagtgattggatcactggggggcagtttcttccatgatgttctcgtaatagtgagttctcatgagatctgatgattttataagtgtttggaaattcctccttcactcttctctttcctgccaacttgtgaagaaggtgccagtttccccttcgaccatgatttcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactatctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcataggtctgtcacttccttctctctttgcgattcattaa

SEQ ID NO: 14364 - DNA, 1163 bp, Artificial Sequence; identical to SEQ ID NO: 13973
  Synthetic polypeptide

SEQ ID NO: 14365 - DNA, 1229 bp, Artificial Sequence; identical to SEQ ID NO: 13974
  Synthetic polypeptide

SEQ ID NO: 14366 - DNA, 553 bp, Artificial Sequence
  Synthetic polypeptide
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagattgatctgaagttaaacaaaaaaccacgagctgactattag

SEQ ID NO: 14367 - DNA, 523 bp, Artificial Sequence
  Synthetic polypeptide
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacaggattgatctgaagttaaacaaaaaaccacgagctgactattag

SEQ ID NO: 14368 - DNA, 526 bp, Artificial Sequence
  Synthetic polypeptide
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagaatgaatgtctcccccaaaactggctggcaccagcttcatctgtga

SEQ ID NO: 14369 - DNA, 523 bp, Artificial Sequence
  Synthetic polypeptide
tccgtgaatcctctaaagtatatgcaaaatttcgcgtgaaacattggcaaatttggagcgacagatctatgcttttgagggaagctacctggaagacactcagatgtatggcaatattattcgtggctgggatcggtatctgaccaaccaaaaaaactccaatagcaaaaatgatcgaaggaaccggaagtttaaggaagctgagcggctcttcagtaaatcctcggttacctcagcagctgcagtaagtgcattggcaggagttcaggaccagctcattgaaaagagggagccaggaagtgggacggaaagtgacacttctccagacttccacaatcaggaaaatgagcccagccaggaggaccctgaggatctggatggatctgtgcagggagtgaaacctcagaaggctgcttcttctacttcctcagggagtcaccacagcagccataaaaagcgaaagaataaaaaccggcacagcccgtctggcatgtttgattatgactttgagtatgtatattag

SEQ ID NO: 14370 - DNA, 1174 bp, Artificial Sequence
  Synthetic polypeptide
gtcagctgctagtaccaatggtgaaatgagaaggcactctaagtgagttcttagacatttctgatggattaggaaccagatactggatttgtcagcctgcatctatgacataaacaaatacacaacaaatgcagtgtagagaaataagaaaaggggttgtatgaatttcttcagcaagtctaccagtcgctgcaactatttcttatcagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 14371 - DNA, 469 bp, Artificial Sequence
  Synthetic polypeptide
gtcagctgctagtaccaatggtgaaatgagaaggcactctaagtgagttcttagacatttctgatggattaggaaccagatactggatttgtcagcctgcatctatgacataaacaaatacacaacaaatgcagtgtagagaaataagaaaaggggttgtatgaatttcttcagcaagtctaccagtcgctgcaactatttcttatcagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttga

SEQ ID NO: 14372 - DNA, 1020 bp, Artificial Sequence
  Synthetic polypeptide
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatccttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatga

SEQ ID NO: 14373 - DNA, 430 bp, Artificial Sequence
  Synthetic polypeptide
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaag

SEQ ID NO: 14374 - DNA, 371 bp, Artificial Sequence
  Synthetic polypeptide
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccag

SEQ ID NO: 14375 - DNA, 282 bp, Artificial Sequence
  Synthetic polypeptide
acccaagtgattcctttggtcctaggatgtcttgtaaagcttaagtcaattagaaacttttcggaggaggatactgtttgtcataagatgccaaaagctcataaggaaaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaacca

SEQ ID NO: 14376 - DNA, 852 bp, Artificial Sequence
  Synthetic polypeptide
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagataagtggtccccagcactgcagatccgcacagttctgctatcgatccaggccttgttaagtgctcccaatccagatgatccattagcaaatgatgtagcggagcagtggaagaccaacgaagcccaagccatagaaacagctagagcatggactaggctatatgccatgaataatatttaa

SEQ ID NO: 14377 - DNA, 852 bp, Artificial Sequence
  Synthetic polypeptide
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaaggtaagtgttatctttatcagcatatgctattattaagctttctcctttttctcttaagcattccatgtttagaatgtaaacattatacaaagatcagagaggtctgtgggagggaagtgaagcagttctgggcctgtttttttcatgctttatcatactgggcctgttgccttcatagataa

SEQ ID NO: 14378 - DNA, 657 bp, Artificial Sequence
  Synthetic polypeptide
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaaataagtggtccccagcactgcagatccgcacagttctgctatcgatccaggccttgttaa

SEQ ID NO: 14379 - DNA, 711 bp, Artificial Sequence
  Synthetic polypeptide
aagcaaagtagaggttcctcttcaaagactttcctccccatctaattaggaataaatagtaacttctcttagaagcaaaatttattcgaagacctgtgcaaacattcttaaatatttgctagccataataaagaaatcaatatactttatgttcttagctcccacaatttagcctaaatatttgccctggcatgcttatactggtccaagcaagcattaggtcatagcctgttcctcttccttatttaaaagtgtttttacctttctcagcattccacaagttacttcctccttcctttgttcccctctacctttacctcttttaaaaagttctaagttgctagccagtcaggacaaatacagaatgtgagatcccgttccagccagtggaaaccggacacagcagtagggtggacgcgtcaggaaacccagcgtttgctggcagaaccagttcctggcatcaaagccgaaccagatgagagcaacgcccgttattttcatgtggtcattgctggccctcaggattccccctttgagggagggacttttaaacttgaactattccttccagaagaatacccaatggcagcccctaaagtacgtttcatgaccaaaatttatcatcctaatgtagacaagttgggaagaatatgtttagatattttgaaagctagagcatggactaggctatatgccatgaataatatttaa

SEQ ID NO: 14380 - DNA, 459 bp, Artificial Sequence; identical to SEQ ID NO: 6625
  Synthetic polypeptide

SEQ ID NO: 14381 - DNA, 177 bp, Artificial Sequence
  Synthetic polypeptide
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttag

SEQ ID NO: 14382 - DNA, 1037 bp, Artificial Sequence
  Synthetic polypeptide
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagagactcttggaggttgtaacctccatttctgacatccccactggtattccagttcacctagagctggccagtatgactaacagggagctcatgagcagcattgtccatcaggtctttcccgcggtgacttcccttgggctgaatgaacaggagctgttatttctcacccagtcagcctctggacctcactcttctctctcttcctggaacggtgttcctgatgtgggcatggtcagtgacatcctcttctggatcttgaaagaacatgggaggagtaaaagcagagcctcggatctcaccaggatccatttccacacgctggtctaccacatcctggcaactgtggatggacactgggccaaccagctggcagccgtggctgcaggagctcgtgtggctgggacacaggcctgcgccacagaaaccatagacaccagccgagtgtctctgagggcaccccaagagttcatgacttcccattcggaggcaggctccaggattgtattaaacccaaacaagccagtagtagaatggcacagagagggaatatccttccacttcacaccagtattggtgtgtaaagaccccattcgaactgtaggccttggagatgccatttcagccgaaggactcttctattcggaagtacaccctcactattag

SEQ ID NO: 14383 - DNA, 227 bp, Artificial Sequence
  Synthetic polypeptide
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcagcaggtctttcccgcggtgacttcccttgggctgaatga

SEQ ID NO: 14384 - DNA, 376 bp, Artificial Sequence
  Synthetic polypeptide
ggctgggtatggtggctcacgcctgtaatccggcactttggaaggccaagacgggcagatcatttgaggttcttctttgcggtccagttggtccaaagctacatgagcttcttgatgacaatgtctttgttccaccagagtcattgcaggaagtggatgagttccacctcattttagagtatcaagcaggggaggagtggggccagttaaaagctccccatgccaaccgattcatcttctctcacgacctctccaacggggccatgaatatgctggaggtgtttgtgtctagcctggaggagtttcagccagacctggtggtcctctctggattgcacatgatggagggacaaagcaaggagctccagaggaagag

SEQ ID NO: 14385 - DNA, 593 bp, Artificial Sequence
  Synthetic polypeptide
caggcatgatggctcgcgcctgtaatctcaacactttggaaggctgaggcagggggattgcttgaggccagaagttcaagaccagcttgggcaacatgatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttgttaaaggtccctggatatgaccagaatatctgctatatttttgggaaggggaccattgagccagtattctatcatggaagtactttataa

SEQ ID NO: 14386 - DNA, 1277 bp, Artificial Sequence
  Synthetic polypeptide
caggcatgatggctcgcgcctgtaatctcaacactttggaaggctgaggcagggggattgcttgaggccagaagttcaagaccagcttgggcaacatgatatttcacagttcttgccgagtgcttcactttttcactagaagtaaacgactttttacagccagtttgttcactttcacaacccagcagacttctttgagattggtctggattttacagaacttgactgaggtgcaaaaggcagttgaagaagaaaattgctgctttgggactattgatacctggttgttatataagctcacaaaaggttctgtatatgccacagatttttcaaatgctagtacaactggactttttgacccatataagatgtgttggagtgggatgattacctctctaatttcgataccactttctctcctacctcctgtgagggacacaagccacaattttggatcagtggatgaagagatatttggtgtgcctataccaatagttgccttggttgctgaccagcaatcagccatgtttggagagtgctgcttccagacaggtgatgtgaaattaaccatgggaactgggacatttttggatattaacactggaaatagccttcaacagactactggaggcttttatccattaattgggtggaagattgggcaagaagtcgtatgcttagctgaaagcaatgcaggagacactggtactgccataaaatgggctcagcagttagaccttttcacagatgctgctgagactgaaaaaatggccaaaagtttggaggattctgaaggagtttgttttgttccatcttttagtggattacaggctccattaaatgacccctgggcatgtgcctcttttatgggtttgaagccttctaccagtaaataccatcttgtacgagcaatattggagtcaatagctttcagaaacaaacagttatatgagatgatgaagaaagagattcatattcctgtaagaaaaatccgggcagatggaggagtttgtaagaatggttttgtcatgcagatgacttcagacctgattaatgagaatatagacagacctgccgacattgacatgtcatgcctgggtgcagcttctctagctggccttgctgttgggttttggactgacaaggaggaactaaagaaactgagacaaagtgaagtggttttcaagccacagaagaaatgtcaagaatatgaaatgagtctggaaaactgggccaaagcagtgaaacgctccatgaattggtataacaagacataa

SEQ ID NO: 14387 - DNA, 345 bp, Artificial Sequence
  Synthetic polypeptide
ggctgggcatggtagctcattcctgtaatcctagcactttgggaggcagagactaggaggcagagactaggcggcagaggcgggtagattgcttgagcttaggagttcaagaccagcctgggcaacatggtgaaaccctctctctacaaaaaaacaaaaattagttgggcgtgttggcttgcgcctgtggtcccagctgcttggaaggctgagtctgaagatgatgagaaactgaaaaagaggaaggagcgatttgggattgtcacaagttcagctggaactggaaccacagaggatacagaggcaaagaagaggaaaagagcagagcgctttgggattgcctga

SEQ ID NO: 14388 - DNA, 354 bp, Artificial Sequence
  Synthetic polypeptide
ggctgggcatggtagctcattcctgtaatcctagcactttgggaggcagagactaggaggcagagactaggcggcagaggcgggtagattgcttgagcttaggagttcaagaccagcctgggcaacatggtgaaaccctctctctacaaaaaaacaaaaattagttgggcgtgttggcttgcgcctgtggtcccagctgcttggaaggctgagtctgaagatgatgagaaactgaaaaagaggaaggagcgatttgggattgtcacaagttcagctggaactggaaccacagaggatacagaggtaaaaatatacctggaacgcttcatagaccttgaagggaaattagagtga

SEQ ID NO: 14389 - DNA, 438 bp, Artificial Sequence
  Synthetic polypeptide
ggccaggcacagtggttcacgcctatgatcccagcactttaggaggccaagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcgggtattgcagatgctccactttctccactgctcacttgcatacccaacaagagaatgaattattttaaaattagagataaataa

SEQ ID NO: 14390 - DNA, 480 bp, Artificial Sequence
  Synthetic polypeptide
ggccaggcacagtggttcacgcctatgatcccagcactttaggaggccaagacctttgaaactcacaactctacgacacctctacaggaaagaagccttggactagatataaatatggattcaaggatcattcatgaaaacatagtagaaaaagagagagtccaacgaataactcaagaaacatttggagattatcctcaaccacaactagaatttgcacaatataagcttgaaacgaaattcaaaagtggtttaaatgggagcatcttggctgagagggaagaacccctccgatgcctaataaagttctctagcccacatcttctggaagcattgaaatccttagcaccagcggcacttgtttgcaggatccaaaagctgctctgctattctggaagccacagtcaagggacccaggacccgagcagctggcagaaggacttgtaccttctgtttgtcccattgtatccaagatgttaa

SEQ ID NO: 14391 - DNA, 1406 bp, Artificial Sequence
  Synthetic polypeptide
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14392 - DNA, 1370 bp, Artificial Sequence
  Synthetic polypeptide
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagctgctgatcccgcacacccgatacaccctgcacatcaacacactcgcccgggagctgcttatcgtgccagggcaggtggtggacaggtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14393 - DNA, 1319 bp, Artificial Sequence
  Synthetic polypeptide
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtgcagtggaacgctttgtctctgaaatcatcggtatctactacccaagtgatgagtctgtccaagatgacagagagctccaggcctgggtcagagagatcttctccaagggcttcctaaaccaggagagctcaggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14394 - DNA, 1184 bp, Artificial Sequence
  Synthetic polypeptide
ggctgggcgcagtggctcacacctgtaatcccagcactttggaaggccaagagcacgcatttgagcactggcaggaggacgccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagagaagggctccctgttcttggtggatcacggcatcctctctggcatccagaccaatgtcattaatgggaagcctcagttctctgcggccccaatgaccctgctataccagagcccaggctgcgggccgctgctgcctctcgccatccagctcagccagacccccggcccaaacagccccatcttcctgcccactgatgacaagtgggactggttgctggccaagacctgggtgcgcaatgccgagttctccttccatgaggccctcacgcacctgctgcactcacatctgctgcctgaggtcttcaccctggctaccctgcgtcagctgccccactgccaccctctcttcaagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatctggggtataccctcctcactggagacccgggaagccctggtgcagtatgtcaccatggtgatattcacctgctccgccaagcatgcggctgtcagtgcagggcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaaaggcccctgggcacctatccggatgagcacttcacagaggaggcccctcggcggagcatcgccaccttccagagccgcctggcccagatctcgaggggcatccaggagcggaaccagggcctggtgctgccctacacctacctagaccctcccctcatcgagaacagcgtctccatctaa

SEQ ID NO: 14395 - DNA, 1114 bp, Artificial Sequence; identical to SEQ ID NO: 9614
  Synthetic polypeptide

SEQ ID NO: 14396 - DNA, 944 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14397 - DNA, 431 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggccaggtga

SEQ ID NO: 14398 - DNA, 746 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14399 - DNA, 842 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcggtgagtcatccctactcccaagatcttgaggggaaaggtgagtggggaccttaa

SEQ ID NO: 14400 - DNA, 533 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccacattgaaccagaggagttcttga

SEQ ID NO: 14401 - DNA, 815 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaagccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14402 - DNA, 875 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagttcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgtgggtcattctgatcaccgaactgaccatgccagccctgccgatggtcctccatggctccctagtgccctggagaggaggtgtctag

SEQ ID NO: 14403 - DNA, 962 bp, Artificial Sequence
  Synthetic polypeptide
gggcaggtggatcagcagtccgacataacaaagataatatctctccgagtttcaaagtcaagcagatttccttgcatctcccttataagattgaagatttgtaaatacatgtaaacagaggttccccagcattgacgcaaaccactgtgtgcgcagcatctgcctgagccactctgatcatccctgtaggacctggggggcaaggtgctgcacccctcatcctgtctcggattgtgggaggctgggagtgcgagaagcattcccaaccctggcaggtgcttgtggcctctcgtggcagggcagtctgcggcggtgttctggtgcacccccagtgggtcctcacagctgcccactgcatcaggaacaaaagcgtgatcttgctgggtcggcacagcctgtttcatcctgaagacacaggccaggtatttcaggtcagccacagcttcccacacccgctctacgatatgagcctcctgaagaatcgattcctcaggccaggtgatgactccagccacgacctcatgctgctccgcctgtcagagcctgccgagctcacggatgctgtgaaggtcatggacctgcccacccaggagccagcactggggaccacctgctacgcctcaggctggggcagcattgaaccagaggagtgtacgcctgggccagatgtcttgaccccaaagaaacttcagtgtgtggacctccatgttatttccaatgacgtgtgtgcgcaagttcaccctcagaaggtgaccaagttcatgctgtgtgctggacgctggacagggggcaaaagcacctgctcgggtgattctgggggcccacttgtctgtaatggtgtgcttcaaggtatcacgtcatggggcagtgaaccatgtgccctgcccgaaaggccttccctgtacaccaaggtggtgcattaccggaagtggatcaaggacaccatcgtggccaacccctga

SEQ ID NO: 14404 - DNA, 829 bp, Artificial Sequence; identical to SEQ ID NO: 8675
  Synthetic polypeptide

SEQ ID NO: 14405 - DNA, 1001 bp, Artificial Sequence
  Synthetic polypeptide
ttaggaaagggatctggccagctctgctagagacactgtgcaactttagtcaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14406 - DNA, 196 bp, Artificial Sequence
  Synthetic polypeptide
gagatcctggggatgttagggaaagggattgtttcttttccttcgctctatcccagggcaggacagtatcaggcacttagtcagctctagatatggaaaacgatccagcccagagacactgatttcagacctcttgatgagagaaagcacagaaaatgttcccagaactcggcttgaagaccctgcaatgtggtga

SEQ ID NO: 14407 - DNA, 535 bp, Artificial Sequence; identical to SEQ ID NO: 10018
  Synthetic polypeptide

SEQ ID NO: 14408 - DNA, 1442 bp, Artificial Sequence
  Synthetic polypeptide
gatggggtcagaaacaggatctgaagtagagcttcttctaatgacccccaggggtgctgagtgatcaagcaaggtacctgcaggacccatttgtgtccattgatctcttggagcagctggggatcatggtaagttcttgctcagatttcagaactccatggatttgtgctttgagctctccgagtttctttgaggaaatttctgttccaaactgggtttggaaatcacaacagaaattggactgggtccgggattgaattagatctggtaattaactggcttggatccagttaaggcctcttacaactgactgggtcagaaagaaactggtagtaaatggtaatattgcagggggtgtaaaatttgggttttggaaattcacagggatttttgtttttcacccctttgtttcatttttcttcagtgcttacacaggaaaaaaaatcattggctaagttaatcaagggaacccgagagcaaacccaatatcctaggagtgtggggctgattgtgctaagttccagaagagtgagctagaattcaagtttaatcggaaagccttggagaggccatacacctcgaagcattcctgggggaagacgtacggggagcacaaacgacatctggagttcagccatgaccagtacagggagctgcagaggtacgccgaggaggttgggatcttcttcactgcctctggcatggatgagatggcagttgaattcctgcatgaactgaatgttccatttttcaaagttggatctggagacactaataattttccttatctggaaaagacagccaaaaaaggtcgcccaatggtgatctccagtgggatgcagtcaatggacaccatgaagcaagtttatcagatcgtgaagcccctcaaccccaacttctgcttcttgcagtgtaccagcgcatacccgctccagcctgaggacgtcaacctgcgggtcatctcggaatatcagaagctctttcctgacattcccatagggtattctgggcatgaaacaggcatagcgatatctgtggccgcagtggctctgggggccaaggtgttggaacgtcacataactttggacaagacctggaaggggagtgaccactcggcctcgctggagcctggagaactggccgagctggtgcggtcagtgcgtcttgtggagcgtgccctgggctccccaaccaagcagctgctgccctgtgagatggcctgcaatgagaagctgggcaagtctgtggtggccaaagtgaaaattccggaaggcaccattctaacaatggacatgctcaccgtgaaggtgggtgagcccaaaggctatcctcctgaagacatctttaatctagtgggcaagaaggtcctggtcactgttgaagaggatgacaccatcatggaagaattggtagataatcatggcaaaaaaatcaagtcttaa

SEQ ID NO: 14409 - DNA, 1346 bp, Artificial Sequence; identical to SEQ ID NO: 7758
  Synthetic polypeptide

SEQ ID NO: 14410 - DNA, 401 bp, Artificial Sequence
  Synthetic polypeptide
attttttatcttttatagagtacttttagtgtgccttttctatgtctagatgtgtttatatatacaaatatttaccattgtgttataattgcctacagtattcagtacagtgcaggtttgtactgtacaggtttgtagccgaggagcaataacctataccatgaagcctaggtgtgtagtaggctacaccgtctatgtttggaaacatcctctaccaccttgatgaaaagacaagccggttttcaatacttatagaggcttgggaacactgcaaaccccttgcatcaaatgagacccttcaagaagccctgtcagaggtgttgaacagcattaattcagctcaggtttacttcaaagcaggacttgatgtgttcaagagtgtcttggatgggaagaattga

SEQ ID NO: 14411 - DNA, 1004 bp, Artificial Sequence
  Synthetic polypeptide
ttttctactcattgttgattgcctgatggtcttcatgagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcagggagatgtgcattgagcaggatgggagagtccatctcactgttgtttactttgggaaagaagaaataaatgaagtcaaaggaatacttgaaaacacttccaaagctgccaacttcaggaactttaccttcatccagctgaatggagaattttctcggggaaagggacttgatgttggagcccgcttctggaagggaagcaacgtccttctctttttctgtgatgtggacatctacttcacatctgaattcctcaatacgtgtaggctgaatacacagccagggaagaaggtattttatccagttcttttcagtcagtacaatcctggcataatatacggccaccatgatgcagtccctcccttggaacagcagctggtcataaagaaggaaactggattttggagagactttggatttgggatgacgtgtcagtatcggtcagacttcatcaatataggtgggtttgatctggacatcaaaggctggggcggagaggatgtgcacctttatcgcaagtatctccacagcaacctcatagtggtacggacgcctgtgcgaggactcttccacctctggcatgagaagcgctgcatggacgagctgacccccgagcagtacaagatgtgcatgcagtccaaggccatgaacgaggcatcccacggccagctgggcatgctggtgttcaggcacgagatagaggctcaccttcgcaaacagaaacagaagacaagtagcaaaaaaacatga

SEQ ID NO: 14412 - DNA, 299 bp, Artificial Sequence
  Synthetic polypeptide
ttttctactcattgttgattgcctgatggtcttcatgagggatctaccgaacagaaagggacaaagggacattgtatgagctcaccttcaaaggggaccacaaacacgaattcaaacggctcatcttatttcgaccattcggccccatcatgaaagtgaaaaatgaaaagctcaacatggccaacacgcttatcaatgttatcgtgcctctagcaaaaagggtggacaagttccggcagttcatgcagaatttcaggcctgctgatgaagtttttagatgtgtgcctttaagcccttga

SEQ ID NO: 14413 - DNA, 959 bp, Artificial Sequence
  Synthetic polypeptide
cagtggatctcaaccaggggcagttttgccccagaggacgtttgtcagtgacatttttggtggtatcattttgggagtgtgctcctggtatctatgcagtagggtccagggatgctagcgaacctcccacaatgcctggggcagcttccaaaatgaagaagtatccagctcagaaggtcatcagtgctgaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtga

SEQ ID NO: 14414 - DNA, 1946 bp, Artificial Sequence; identical to SEQ ID NO: 7119
  Synthetic polypeptide

SEQ ID NO: 14415 - DNA, 1565 bp, Artificial Sequence
  Synthetic polypeptide
aaagaatatgactgcattatttgatgttttactactaaaagcttttaaggttcactcttgtcttttcttgtacccttaatctgggcagtatgataaaaaaaaaagccagagtgctcccacctttggtgccaggggagattcaaatcacacaaacctcaaccttcatgcaggaaggctcacaccagcctaccccctaaccacaatgaaaccctaagacctgtctcttttcactgttttctcaagtcattttcagatcagcttgagaggactgcccttctttccccagagaagtctcattgtgtatgaaataaacctcttcataccctctcaagtatggaccaatatttacagtctttgctatgggaaaccgaatgacctttgttactgaagaagaaggaattaatgtgtttctaaaatccaaaaaagtagattttgaactagcagtgcaaaatatcgtttatcgtacagcatcaattccaaagaatgtctttttagcactgcatgaaaaactctatattatgttgaaagggaaaatggggactgtcaatctccatcagtttactgggcaactgactgaagaattacatgaacaactggagaatttaggcactcatgggacaatggacctgaacaacttagtaagacatctcctttatccagtcacagtgaatatgctctttaataaaagtttgttttccacaaacaagaaaaaaatcaaggagttccatcagtattttcaagtttatgatgaagattttgagtatgggtcccagttgccagagtgtcttctaagaaactggtcaaaatccaaaaagtggttcctggaactgtttgagaaaaacattccagatataaaagcatgtaaatctgcaaaagataattccatgacattattgcaagctacgctggatattgtagagacggaaacaagtaaggaaaactcacccaattatgggctcttactgctttgggcttctctgtctaatgctgttcctgttgcattttggacacttgcatacgtcctttctcatcctgatatccacaaggccattatggaaggcatatcttctgtgtttggcaaagcaggcaaagataagattaaagtgtctgaggatgacctggagaatctccttctaattaaatggtgtgttttggaaaccattcgtttaaaagctcctggtgtcattactagaaaagtggtgaagcctgtggaaattttgaattacatcattccttctggtgacttgttgatgttgtctccattttggctgcatagaaatccaaagtattttcctgagcctgaattgttcaaacctgaacgttggaaaaaggcaaatttagagaagcactctttcttggactgcttcatggcatttggaagcgggaagttccagtgtcctgcaaggtggtttgctctgttagaggttcagatgtgtattattttaatactttataaatatgactgtagtcttctggacccattacccaaacagagttatctccatttggtgggtgtcccccagccggaagggcaatgccgaattgaatataaacaaagaatatga

SEQ ID NO: 14416 - DNA, 330 bp, Artificial Sequence
  Synthetic polypeptide
tctctctgctcccgcctccttatcctctctcactttgccgagataattccccctcttcttttggatctcaattcagtcaccactcctcaggaaaacctttcctgacctctctaactaggtctgatccttatgtttcactctgaggatactgtgcacctctcatttatagcatttttttataggtggaattttatatttatttgattgtctccttattagacccttagctccattagggagcaagtttgtctggactcagtctcaccccagcacttaggtgcttgcactctgatctacaaatttggaagaaccgaagagctatggacctga

SEQ ID NO: 14417 - DNA, 305 bp, Artificial Sequence; identical to SEQ ID NO: 13125
  Synthetic polypeptide

SEQ ID NO: 14418 - DNA, 122 bp, Artificial Sequence
  Synthetic polypeptide
gccagttgtttgagaacttctactttggctccctaaagctgaattcaattcacatctctcagaggttcaccgtagacagctttggaaactacgcttcctgtggacaaattgacttctcctga

SEQ ID NO: 14419 - DNA, 13 bp, Artificial Sequence
  Synthetic polypeptide
gccagttgtttga

SEQ ID NO: 14420 - DNA, 163 bp, Artificial Sequence; identical to SEQ ID NO: 480
  Synthetic polypeptide

SEQ ID NO: 14421 - DNA, 104 bp, Artificial Sequence; identical to SEQ ID NO: 481
  Synthetic polypeptide

SEQ ID NO: 14422 - DNA, 820 bp, Artificial Sequence; identical to SEQ ID NO: 7641
  Synthetic polypeptide

SEQ ID NO: 14423 - DNA, 946 bp, Artificial Sequence; identical to SEQ ID NO: 7642
  Synthetic polypeptide

SEQ ID NO: 14424 - DNA, 382 bp, Artificial Sequence; identical to SEQ ID NO: 434
  Synthetic polypeptide

SEQ ID NO: 14425 - DNA, 999 bp, Artificial Sequence; identical to SEQ ID NO: 7664
  Synthetic polypeptide

SEQ ID NO: 14426 - DNA, 1267 bp, Artificial Sequence; identical to SEQ ID NO: 463
  Synthetic polypeptide

SEQ ID NO: 14427 - DNA, 1086 bp, Artificial Sequence; identical to SEQ ID NO: 6423
  Synthetic polypeptide

SEQ ID NO: 14428 - DNA, 2419 bp, Artificial Sequence; identical to SEQ ID NO: 7455
  Synthetic polypeptide

SEQ ID NO: 14429 - DNA, 527 bp, Artificial Sequence; identical to SEQ ID NO: 7665
  Synthetic polypeptide

SEQ ID NO: 14430 - DNA, 1086 bp, Artificial Sequence; identical to SEQ ID NO: 444
  Synthetic polypeptide

SEQ ID NO: 14431 - DNA, 564 bp, Artificial Sequence; identical to SEQ ID NO: 445
  Synthetic polypeptide

SEQ ID NO: 14432 - DNA, 987 bp, Artificial Sequence; identical to SEQ ID NO: 446
  Synthetic polypeptide

SEQ ID NO: 14433 - DNA, 1138 bp, Artificial Sequence; identical to SEQ ID NO: 7655
  Synthetic polypeptide

SEQ ID NO: 14434 - DNA, 470 bp, Artificial Sequence; identical to SEQ ID NO: 7659
  Synthetic polypeptide

SEQ ID NO: 14435 - DNA, 611 bp, Artificial Sequence; identical to SEQ ID NO: 7660
  Synthetic polypeptide

SEQ ID NO: 14436 - DNA, 347 bp, Artificial Sequence; identical to SEQ ID NO: 7661
  Synthetic polypeptide

SEQ ID NO: 14437 - DNA, 366 bp, Artificial Sequence; identical to SEQ ID NO: 7663
  Synthetic polypeptide

SEQ ID NO: 14438 - DNA, 451 bp, Artificial Sequence; identical to SEQ ID NO: 7666
  Synthetic polypeptide

SEQ ID NO: 14439 - DNA, 161 bp, Artificial Sequence; identical to SEQ ID NO: 7668
  Synthetic polypeptide

SEQ ID NO: 14440 - DNA, 178 bp, Artificial Sequence; identical to SEQ ID NO: 7669
  Synthetic polypeptide

SEQ ID NO: 14441 - DNA, 2319 bp, Artificial Sequence; identical to SEQ ID NO: 6366
  Synthetic polypeptide

SEQ ID NO: 14442 - DNA, 2564 bp, Artificial Sequence; identical to SEQ ID NO: 7690
  Synthetic polypeptide

SEQ ID NO: 14443 - DNA, 1448 bp, Artificial Sequence; identical to SEQ ID NO: 7691
  Synthetic polypeptide

SEQ ID NO: 14444 - DNA, 2417 bp, Artificial Sequence; identical to SEQ ID NO: 7692
  Synthetic polypeptide

SEQ ID NO: 14445 - DNA, 1206 bp, Artificial Sequence; identical to SEQ ID NO: 7670
  Synthetic polypeptide

SEQ ID NO: 14446 - DNA, 1134 bp, Artificial Sequence; identical to SEQ ID NO: 7671
  Synthetic polypeptide

SEQ ID NO: 14447 - DNA, 1002 bp, Artificial Sequence; identical to SEQ ID NO: 7672
  Synthetic polypeptide

SEQ ID NO: 14448 - DNA, 279 bp, Artificial Sequence; identical to SEQ ID NO: 7673
  Synthetic polypeptide

SEQ ID NO: 14449 - DNA, 1983 bp, Artificial Sequence; identical to SEQ ID NO: 7685
  Synthetic polypeptide

SEQ ID NO: 14450 - DNA, 192 bp, Artificial Sequence; identical to SEQ ID NO: 8269
  Synthetic polypeptide

SEQ ID NO: 14451 - DNA, 3021 bp, Artificial Sequence; identical to SEQ ID NO: 449
  Synthetic polypeptide

SEQ ID NO: 14452 - DNA, 3075 bp, Artificial Sequence; identical to SEQ ID NO: 450
  Synthetic polypeptide

SEQ ID NO: 14453 - DNA, 1143 bp, Artificial Sequence; identical to SEQ ID NO: 451
  Synthetic polypeptide

SEQ ID NO: 14454 - DNA, 1111 bp, Artificial Sequence
  Synthetic polypeptide
ccgggcatggtggctcacacccgtaatcccagcactttgagaggccaaggcgggcagatcacttgaggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtga

SEQ ID NO: 14455 - DNA, 333 bp, Artificial Sequence; identical to SEQ ID NO: 6583
  Synthetic polypeptide

SEQ ID NO: 14456 - DNA, 629 bp, Artificial Sequence; identical to SEQ ID NO: 7943
  Synthetic polypeptide

SEQ ID NO: 14457 - DNA, 472 bp, Artificial Sequence; identical to SEQ ID NO: 7944
  Synthetic polypeptide

SEQ ID NO: 14458 - DNA, 567 bp, Artificial Sequence; identical to SEQ ID NO: 7689
  Synthetic polypeptide

SEQ ID NO: 14459 - DNA, 1926 bp, Artificial Sequence; identical to SEQ ID NO: 7679
  Synthetic polypeptide

SEQ ID NO: 14460 - DNA, 477 bp, Artificial Sequence; identical to SEQ ID NO: 7680
  Synthetic polypeptide

SEQ ID NO: 14461 - DNA, 711 bp, Artificial Sequence; identical to SEQ ID NO: 7681
  Synthetic polypeptide

SEQ ID NO: 14462 - DNA, 288 bp, Artificial Sequence; identical to SEQ ID NO: 7682
  Synthetic polypeptide

SEQ ID NO: 14463 - DNA, 237 bp, Artificial Sequence; identical to SEQ ID NO: 7683
  Synthetic polypeptide

SEQ ID NO: 14464 - DNA, 703 bp, Artificial Sequence; identical to SEQ ID NO: 7684
  Synthetic polypeptide

SEQ ID NO: 14465 - DNA, 851 bp, Artificial Sequence
  Synthetic polypeptide
caggggtcccaatccgtgagccgcagaccagtaactgtctgtggtttgtgagaaacgaggccacacagcaggaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttga

SEQ ID NO: 14466 - DNA, 449 bp, Artificial Sequence
  Synthetic polypeptide
caggggtcccaatccgtgagccgcagaccagtaactgtctgtggtttgtgagaaacgaggccacacagcaggaggcccggggctcaagcccagtgtcactagacctcatcattcccttcctgaggccagggtgctgtgtcctgctccatgcttcactcagctccccgggaggagaagatgcctggctcataggggtggggggctctgtgccctcaggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctga

SEQ ID NO: 14467 - DNA, 545 bp, Artificial Sequence; identical to SEQ ID NO: 7336
  Synthetic polypeptide

SEQ ID NO: 14468 - DNA, 1029 bp, Artificial Sequence; identical to SEQ ID NO: 8732
  Synthetic polypeptide

SEQ ID NO: 14469 - DNA, 1170 bp, Artificial Sequence; identical to SEQ ID NO: 8733
  Synthetic polypeptide

SEQ ID NO: 14470 - DNA, 1062 bp, Artificial Sequence; identical to SEQ ID NO: 8734
  Synthetic polypeptide

SEQ ID NO: 14471 - DNA, 573 bp, Artificial Sequence; identical to SEQ ID NO: 8735
  Synthetic polypeptide

SEQ ID NO: 14472 - DNA, 299 bp, Artificial Sequence; identical to SEQ ID NO: 8736
  Synthetic polypeptide

SEQ ID NO: 14473 - DNA, 330 bp, Artificial Sequence; identical to SEQ ID NO: 6490
  Synthetic polypeptide

SEQ ID NO: 14474 - DNA, 342 bp, Artificial Sequence; identical to SEQ ID NO: 7076
  Synthetic polypeptide

SEQ ID NO: 14475 - DNA, 1516 bp, Artificial Sequence; identical to SEQ ID NO: 7077
  Synthetic polypeptide

SEQ ID NO: 14476 - DNA, 1444 bp, Artificial Sequence; identical to SEQ ID NO: 7078
  Synthetic polypeptide

SEQ ID NO: 14477 - DNA, 1312 bp, Artificial Sequence; identical to SEQ ID NO: 7079
  Synthetic polypeptide

SEQ ID NO: 14478 - DNA, 1609 bp, Artificial Sequence; identical to SEQ ID NO: 7721
  Synthetic polypeptide

SEQ ID NO: 14479 - DNA, 1525 bp, Artificial Sequence; identical to SEQ ID NO: 7722
  Synthetic polypeptide

SEQ ID NO: 14480 - DNA, 436 bp, Artificial Sequence; identical to SEQ ID NO: 7723
  Synthetic polypeptide

SEQ ID NO: 14481 - DNA, 1883 bp, Artificial Sequence; identical to SEQ ID NO: 6345
  Synthetic polypeptide

SEQ ID NO: 14482 - DNA, 404 bp, Artificial Sequence; identical to SEQ ID NO: 7701
  Synthetic polypeptide

SEQ ID NO: 14483 - DNA, 336 bp, Artificial Sequence; identical to SEQ ID NO: 7702
  Synthetic polypeptide

SEQ ID NO: 14484 - DNA, 3325 bp, Artificial Sequence; identical to SEQ ID NO: 7703
  Synthetic polypeptide

SEQ ID NO: 14485 - DNA, 169 bp, Artificial Sequence; identical to SEQ ID NO: 7704
  Synthetic polypeptide

SEQ ID NO: 14486 - DNA, 169 bp, Artificial Sequence; identical to SEQ ID NO: 7705
  Synthetic polypeptide

SEQ ID NO: 14487 - DNA, 241 bp, Artificial Sequence; identical to SEQ ID NO: 7706
  Synthetic polypeptide

SEQ ID NO: 14488 - DNA, 273 bp, Artificial Sequence; identical to SEQ ID NO: 7707
  Synthetic polypeptide

SEQ ID NO: 14489 - DNA, 329 bp, Artificial Sequence; identical to SEQ ID NO: 7708
  Synthetic polypeptide

SEQ ID NO: 14490 - DNA, 203 bp, Artificial Sequence; identical to SEQ ID NO: 7709
  Synthetic polypeptide

SEQ ID NO: 14491 - DNA, 271 bp, Artificial Sequence; identical to SEQ ID NO: 7710
  Synthetic polypeptide

SEQ ID NO: 14492 - DNA, 297 bp, Artificial Sequence; identical to SEQ ID NO: 7711
  Synthetic polypeptide

SEQ ID NO: 14493 - DNA, 127 bp, Artificial Sequence; identical to SEQ ID NO: 7712
  Synthetic polypeptide

SEQ ID NO: 14494 - DNA, 1325 bp, Artificial Sequence; identical to SEQ ID NO: 7686
  Synthetic polypeptide

SEQ ID NO: 14495 - DNA, 1691 bp, Artificial Sequence; identical to SEQ ID NO: 7687
  Synthetic polypeptide

SEQ ID NO: 14496 - DNA, 1541 bp, Artificial Sequence; identical to SEQ ID NO: 7688
  Synthetic polypeptide

SEQ ID NO: 14497 - DNA, 873 bp, Artificial Sequence; identical to SEQ ID NO: 8120
  Synthetic polypeptide

SEQ ID NO: 14498 - DNA, 921 bp, Artificial Sequence; identical to SEQ ID NO: 8121
  Synthetic polypeptide

SEQ ID NO: 14499 - DNA, 1717 bp, Artificial Sequence
  Synthetic polypeptide
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtga

SEQ ID NO: 14500 - DNA, 502 bp, Artificial Sequence
  Synthetic polypeptide
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagtacaaccggcacgacagccccgaagatgtgaagcgacgagccatggccgaccctga

SEQ ID NO: 14501 - DNA, 1645 bp, Artificial Sequence
  Synthetic polypeptide
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggcactgaaagaaaaagagctggggaacgatgcctacaagaagaaagactttgacacagccttgaagcattacgacaaagccaaggagctggaccccactaacatgacttacattaccaatcaagcagcggtatactttgaaaagggcgactacaataagtgccgggagctttgtgagaaggccattgaagtggggagagaaaaccgagaagactatcgacagattgccaaagcatatgctcgaattggcaactcctacttcaaagaagaaaagtacaaggatgccatccatttctataacaagtctctggcagagcaccgaaccccagatgtgctcaagaaatgccagcaggcagagaaaatcctgaaggagcaagagcggctggcctacataaaccccgacctggctttggaggagaagaacaaaggcaacgagtgttttcagaaaggggactatccccaggccatgaagcattatacagaagccatcaaaaggaacccgaaagatgccaaattatacagcaatcgagctgcctgctacaccaaactcctggagttccagctggcactcaaggactgtgaggaatgtatccagctggagccgaccttcatcaagggttatacacggaaagccgctgcgctggaagcgatgaaggactacaccaaagccatggatgtgtaccagaaggcgctagacctggactccagctgtaaggaggcggcagacggctaccagcgctgtatgatggcgcagtacaaccggcacgacagccccgaagatgtgaagcgacgagccatggccgaccctgaggtgcagcagatcatgagtgacccagccatgcgccttatcctggaacagatgcagaaggacccccaggcactcagcgaacacttaaagaatcctgtaatagcacagaagatccagaagctgatggatgtgggtctgattgcaattcggtga

SEQ ID NO: 14502 - DNA, 796 bp, Artificial Sequence
  Synthetic polypeptide
ggcggtggccaggccgcggtaggggggcggggcgggcgccggatccaggagaccggagctcggcgctggggccggacggggcggcggcggggaggtcaatgagctgaaggagaaaggcaacaaggccctgagcgtgggtaacatcgatgatgccttacagtgctactccgaagctattaagctggatccccacaaccacgtgctgtacagcaaccgttctgctgcctatgccaagaaaggagactaccagaaggcttatgaggatggctgcaagactgtcgacctaaagcctgactggggcaagggctattcacgaaaagcagcagctctagagttcttaaaccgctttgaagaagccaagcgaacctatgaggagggcttaaaacacgaggcaaataaccctcaactgaaagagggtttacagaatatggaggccaggttggcagagagaaaattcatgaaccctttcaacatgcctaatctgtatcagaagttggagagtgatcccaggacaaggacactactcagtgatcctacctaccgggagctgatagagcagctacgaaacaagccttctgacctgggcacgaaactacaagatccccggatcatgaccactctcagcgtcctccttggggtcgatctgggcagtatggatgaggaggaagagattgcaacacctccaccaccaccccctcccaaaaaggagaccaagccagagccaatggaagaagatcttccagagaataagaagcaggtcttgtttttttctctcctcactgtcacctatctataa

SEQ ID NO: 14503 - DNA, 978 bp, Artificial Sequence
  Synthetic polypeptide
ataaaaacaatcagatacagtttccttcaagtggcagggtcagtaatagcctttaactgttttatctcaaggctctatttagctggttttctatcataatatattttggaagaactttagtcatcttgaaacaaagctggtattacattaatgacatctggttgttctccgtggataggaattataaagccctctagatgcctcagtatgacaatatgacacatgcatcccagaccaatataaaatctgcaaagttcaggaaccttctatactgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaa

SEQ ID NO: 14504 - DNA, 731 bp, Artificial Sequence
  Synthetic polypeptide
ataaaaacaatcagatacagtttccttcaagtggcagggtcagtaatagcctttaactgttttatctcaaggctctatttagctggttttctatcataatatattttggaagaactttagtcatcttgaaacaaagctggtattacattaatgacatctggttgttctccgtggataggaattataaagccctctagatgcctcagtatgacaatatgacacatgcatcccagaccaatataaaatctgcaaagttcaggaaccttctatactgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccacccctccagctgctggcactgagtgcctcatctccggctggggcaacactctgagctttggtgctgactacccagacgagctgaagtgcctggatgctccggtgct

SEQ ID NO: 14505 - DNA, 1461 bp, Artificial Sequence; identical to SEQ ID NO: 7696
  Synthetic polypeptide

SEQ ID NO: 14506 - DNA, 369 bp, Artificial Sequence; identical to SEQ ID NO: 6429
  Synthetic polypeptide

SEQ ID NO: 14507 - DNA, 201 bp, Artificial Sequence; identical to SEQ ID NO: 6430
  Synthetic polypeptide

SEQ ID NO: 14508 - DNA, 1238 bp, Artificial Sequence; identical to SEQ ID NO: 7778
  Synthetic polypeptide

SEQ ID NO: 14509 - DNA, 1085 bp, Artificial Sequence; identical to SEQ ID NO: 7779
  Synthetic polypeptide

SEQ ID NO: 14510 - DNA, 455 bp, Artificial Sequence; identical to SEQ ID NO: 7734
  Synthetic polypeptide

SEQ ID NO: 14511 - DNA, 295 bp, Artificial Sequence; identical to SEQ ID NO: 7744
  Synthetic polypeptide

SEQ ID NO: 14512 - DNA, 286 bp, Artificial Sequence; identical to SEQ ID NO: 7745
  Synthetic polypeptide

SEQ ID NO: 14513 - DNA, 3541 bp, Artificial Sequence; identical to SEQ ID NO: 7746
  Synthetic polypeptide

SEQ ID NO: 14514 - DNA, 3520 bp, Artificial Sequence; identical to SEQ ID NO: 7747
  Synthetic polypeptide

SEQ ID NO: 14515 - DNA, 200 bp, Artificial Sequence; identical to SEQ ID NO: 7748
  Synthetic polypeptide

SEQ ID NO: 14516 - DNA, 135 bp, Artificial Sequence; identical to SEQ ID NO: 7749
  Synthetic polypeptide

SEQ ID NO: 14517 - DNA, 3484 bp, Artificial Sequence; identical to SEQ ID NO: 7750
  Synthetic polypeptide

SEQ ID NO: 14518 - DNA, 311 bp, Artificial Sequence; identical to SEQ ID NO: 7757
  Synthetic polypeptide

SEQ ID NO: 14519 - DNA, 1346 bp, Artificial Sequence; identical to SEQ ID NO: 7758
  Synthetic polypeptide

SEQ ID NO: 14520 - DNA, 1508 bp, Artificial Sequence; identical to SEQ ID NO: 7729
  Synthetic polypeptide

SEQ ID NO: 14521 - DNA, 603 bp, Artificial Sequence; identical to SEQ ID NO: 7730
  Synthetic polypeptide

SEQ ID NO: 14522 - DNA, 909 bp, Artificial Sequence; identical to SEQ ID NO: 7731
  Synthetic polypeptide

SEQ ID NO: 14523 - DNA, 807 bp, Artificial Sequence; identical to SEQ ID NO: 7401
  Synthetic polypeptide

SEQ ID NO: 14524 - DNA, 453 bp, Artificial Sequence; identical to SEQ ID NO: 7402
  Synthetic polypeptide

SEQ ID NO: 14525 - DNA, 382 bp, Artificial Sequence; identical to SEQ ID NO: 434
  Synthetic polypeptide

SEQ ID NO: 14526 - DNA, 529 bp, Artificial Sequence; identical to SEQ ID NO: 12735
  Synthetic polypeptide

SEQ ID NO: 14527 - DNA, 1317 bp, Artificial Sequence; identical to SEQ ID NO: 12736
  Synthetic polypeptide

SEQ ID NO: 14528 - DNA, 1221 bp, Artificial Sequence; identical to SEQ ID NO: 12737
  Synthetic polypeptide

SEQ ID NO: 14529 - DNA, 1200 bp, Artificial Sequence; identical to SEQ ID NO: 12738
  Synthetic polypeptide

SEQ ID NO: 14530 - DNA, 922 bp, Artificial Sequence; identical to SEQ ID NO: 12739
  Synthetic polypeptide

SEQ ID NO: 14531 - DNA, 632 bp, Artificial Sequence; identical to SEQ ID NO: 12740
  Synthetic polypeptide

SEQ ID NO: 14532 - DNA, 1320 bp, Artificial Sequence; identical to SEQ ID NO: 8817
  Synthetic polypeptide

SEQ ID NO: 14533 - DNA, 420 bp, Artificial Sequence; identical to SEQ ID NO: 8818
  Synthetic polypeptide

SEQ ID NO: 14534 - DNA, 355 bp, Artificial Sequence; identical to SEQ ID NO: 8039
  Synthetic polypeptide

SEQ ID NO: 14535 - DNA, 1133 bp, Artificial Sequence; identical to SEQ ID NO: 7332
  Synthetic polypeptide

SEQ ID NO: 14536 - DNA, 1172 bp, Artificial Sequence; identical to SEQ ID NO: 7333
  Synthetic polypeptide

SEQ ID NO: 14537 - DNA, 434 bp, Artificial Sequence; identical to SEQ ID NO: 8041
  Synthetic polypeptide

SEQ ID NO: 14538 - DNA, 526 bp, Artificial Sequence; identical to SEQ ID NO: 10237
  Synthetic polypeptide

SEQ ID NO: 14539 - DNA, 1314 bp, Artificial Sequence; identical to SEQ ID NO: 10238
  Synthetic polypeptide

SEQ ID NO: 14540 - DNA, 1218 bp, Artificial Sequence; identical to SEQ ID NO: 10239
  Synthetic polypeptide

SEQ ID NO: 14541 - DNA, 1197 bp, Artificial Sequence; identical to SEQ ID NO: 10240
  Synthetic polypeptide

SEQ ID NO: 14542 - DNA, 919 bp, Artificial Sequence; identical to SEQ ID NO: 10241
  Synthetic polypeptide

SEQ ID NO: 14543 - DNA, 629 bp, Artificial Sequence; identical to SEQ ID NO: 10242
  Synthetic polypeptide

SEQ ID NO: 14544 - DNA, 80 bp, Artificial Sequence; identical to SEQ ID NO: 6364
  Synthetic polypeptide

SEQ ID NO: 14545 - DNA, 217 bp, Artificial Sequence; identical to SEQ ID NO: 6365
  Synthetic polypeptide

SEQ ID NO: 14546 - DNA, 560 bp, Artificial Sequence; identical to SEQ ID NO: 6322
  Synthetic polypeptide

SEQ ID NO: 14547 - DNA, 2200 bp, Artificial Sequence
  Synthetic polypeptide
ggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctga

SEQ ID NO: 14548 - DNA, 2173 bp, Artificial Sequence
  Synthetic polypeptide
ggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcaaacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctga

SEQ ID NO: 14549 - DNA, 1409 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14550 - DNA, 1463 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14551 - DNA, 1667 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggtgctgcaggagcaggagtgctgggtgggctagtgccaggtgccccaggcgcagtcccaggtgtgccgggcacgggaggagtgccaggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14552 - DNA, 1328 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggagccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14553 - DNA, 1406 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14554 - DNA, 1481 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgctcttctcaatcttgcagggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14555 - DNA, 1352 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14556 - DNA, 1307 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcaggagctgcagctgggcttggtgctggcatccctggacttggagttggtgtcggcgtccctggacttggagttggtgctggtgttcctggacttggagttggtgctggtgttcctggcttcggggcagtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatga

SEQ ID NO: 14557 - DNA, 1562 bp, Artificial Sequence
  Synthetic polypeptide
gcacagtggctcacgcctgtaatcccaacaatttgggaggctaaaaccaggagtttgagaccagcctgagcaacatactgagaccccatctttccaaaaagtatttaaaaattatctaggcatggtggcacatgcctgtggtcccagccacctgcaaggctgaggtgagaggattgcttgagcctagtagttcaaggctgcagtgagctatgatcatgccactgcactccagcctgggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtcggagtcggaggtatccctggagtcgcaggtgtccctggtgtcggaggtgttcccggagtcggaggtgtcccgggagttggcatttcccccgaagctcaggcagcagctgccgccaaggctgccaagtacggagtggggaccccagcagctgcagctgctaaagcagccgccaaagccgcccagtttgggttagttcctggtgtcggcgtggctcctggagttggcgtggctcctggtgtcggtgtggctcctggagttggcttggctcctggagttggcgtggctcctggagttggtgtggctcctggcgttggcgtggctcccggcattggccctggtggagttgcagctgcagcaaaatccgctgccaaggtggctgccaaagcccagctccgagctgcagctgggcttggtgctggcatccctggacttggagttggtgtcggcgtccctggacttggagttggtgctggtgttcctggacttggagttggtgctggtgttcctggcttcggggcaggtgcagatgagggagttaggcggagcctgtcccctgagctcagggaaggagatccctcctcctctcagcacctccccagcaccccctcatcacccagggtacctggagccctggctgccgctaaagcagccaaatatggagcagcagtgcctggggtccttggagggctcggggctctcggtggagtaggcatcccaggcggtgtggtgggagccggacccgccgccgccgctgccgcagccaaagctgctgccaaagccgcccagtttggcctagtgggagccgctgggctcggaggactcggagtcggagggcttggagttccaggtgttgggggccttggaggtatacctccagctgcagccgctaaagcagctaaatacggtgctgctggccttggaggtgtcctagggggtgccgggcagttcccacttggaggagtggcagcaagacctggcttcggattgtctcccattttcccaggtggggcctgcctggggaaagcttgtggccggaagagaaaatga

SEQ ID NO: 14558 - DNA, 1045 bp, Artificial Sequence; identical to SEQ ID NO: 8898
  Synthetic polypeptide

SEQ ID NO: 14559 - DNA, 1861 bp, Artificial Sequence; identical to SEQ ID NO: 6680
  Synthetic polypeptide

SEQ ID NO: 14560 - DNA, 1123 bp, Artificial Sequence; identical to SEQ ID NO: 6681
  Synthetic polypeptide

SEQ ID NO: 14561 - DNA, 540 bp, Artificial Sequence; identical to SEQ ID NO: 6590
  Synthetic polypeptide

SEQ ID NO: 14562 - DNA, 163 bp, Artificial Sequence; identical to SEQ ID NO: 480
  Synthetic polypeptide

SEQ ID NO: 14563 - DNA, 104 bp, Artificial Sequence; identical to SEQ ID NO: 481
  Synthetic polypeptide

SEQ ID NO: 14564 - DNA, 309 bp, Artificial Sequence; identical to SEQ ID NO: 7876
  Synthetic polypeptide

SEQ ID NO: 14565 - DNA, 588 bp, Artificial Sequence; identical to SEQ ID NO: 6349
  Synthetic polypeptide

SEQ ID NO: 14566 - DNA, 1376 bp, Artificial Sequence; identical to SEQ ID NO: 6350
  Synthetic polypeptide

SEQ ID NO: 14567 - DNA, 1280 bp, Artificial Sequence; identical to SEQ ID NO: 6351
  Synthetic polypeptide

SEQ ID NO: 14568 - DNA, 1259 bp, Artificial Sequence; identical to SEQ ID NO: 6352
  Synthetic polypeptide

SEQ ID NO: 14569 - DNA, 981 bp, Artificial Sequence; identical to SEQ ID NO: 6353
  Synthetic polypeptide

SEQ ID NO: 14570 - DNA, 691 bp, Artificial Sequence; identical to SEQ ID NO: 6354
  Synthetic polypeptide

SEQ ID NO: 14571 - DNA, 841 bp, Artificial Sequence
  Synthetic polypeptide
ggctgggcgtggtggctcatgcctgtaatcccagcactttgggaggctgaggtgggtggatcacctgaggtcaggagttcgagaccagcctggccaacatggtgaaaccccatctctactaaaaaaaaaaaaaaaacattagctgggcacctgtaatctcagctacttgtgaggctgaggcaggaaaatcacttgaacctgggaggtagagggcgaggtgggctgcttcctcagccattactccatctgggaagaggtggttgccaggggcctggcccgggtcctggtgtttgaggatgacgtgcgctttgagagcaacttcagggggcggctggagcggctgatggaggatgtggaggcagagaaactgtcttgggacctgatctacctcggacggaagcaggtgaaccctgagaaggagacggccgtggaggggctgccgggcctggtggtggctgggtactcctactggacgctggcctatgccctgcgtctggcgggtgcccgcaagctgctggcctcacagcctctgcgccgcatgctgcccgtggacgagttcctgcccatcatgttcgaccagcaccccaacgagcagtacaaggcacacttctggccacgggacctggtggccttctccgcccagcccctgctcgctgcccctacccactatgccggggacgccgagtggctcagtgacacggagacatcctctccatgggatgatgacagcggccgcctcatcagctggagcggctcccaaaagaccctgcgcagcccccgcctggacctgactggcagcagcgggcacagcctccaaccccagccccgagatgagctctag

SEQ ID NO: 14572 - DNA, 161 bp, Artificial Sequence; identical to SEQ ID NO: 7668
  Synthetic polypeptide

SEQ ID NO: 14573 - DNA, 178 bp, Artificial Sequence; identical to SEQ ID NO: 7669
  Synthetic polypeptide

SEQ ID NO: 14574 - DNA, 763 bp, Artificial Sequence; identical to SEQ ID NO: 606
  Synthetic polypeptide

SEQ ID NO: 14575 - DNA, 952 bp, Artificial Sequence; identical to SEQ ID NO: 8583
  Synthetic polypeptide

SEQ ID NO: 14576 - DNA, 87 bp, Artificial Sequence; identical to SEQ ID NO: 8584
  Synthetic polypeptide

SEQ ID NO: 14577 - DNA, 1084 bp, Artificial Sequence; identical to SEQ ID NO: 580
  Synthetic polypeptide

SEQ ID NO: 14578 - DNA, 871 bp, Artificial Sequence; identical to SEQ ID NO: 437
  Synthetic polypeptide

SEQ ID NO: 14579 - DNA, 421 bp, Artificial Sequence; identical to SEQ ID NO: 441
  Synthetic polypeptide

SEQ ID NO: 14580 - DNA, 638 bp, Artificial Sequence; identical to SEQ ID NO: 442
  Synthetic polypeptide

SEQ ID NO: 14581 - DNA, 337 bp, Artificial Sequence; identical to SEQ ID NO: 443
  Synthetic polypeptide

SEQ ID NO: 14582 - DNA, 337 bp, Artificial Sequence; identical to SEQ ID NO: 6393
  Synthetic polypeptide

SEQ ID NO: 14583 - DNA, 1344 bp, Artificial Sequence
  Synthetic polypeptide
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagctcatcgacttcggcatcgcgcacaagatcgaggcggggaacgagttcaagaacatcttcggcaccccggagtttgtggccccagagattgtgaactatgagccgctgggcctggaggcggacatgtggagcatcggtgtcatcacctatatcctcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagcggagaatgaccattgcccagagcctggaacattcctggattaaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctag

SEQ ID NO: 14584 - DNA, 454 bp, Artificial Sequence
  Synthetic polypeptide
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaagc

SEQ ID NO: 14585 - DNA, 453 bp, Artificial Sequence
  Synthetic polypeptide
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaagccggaaaacatcatgctgctggacaagaacgtgcccaacccacgaatcaag

SEQ ID NO: 14586 - DNA, 402 bp, Artificial Sequence
  Synthetic polypeptide
agagcacctgggctctggagcctgcagcacctggtttgaagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaag

SEQ ID NO: 14587 - DNA, 700 bp, Artificial Sequence
  Synthetic polypeptide
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattggtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataa

SEQ ID NO: 14588 - DNA, 233 bp, Artificial Sequence
  Synthetic polypeptide
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactag

SEQ ID NO: 14589 - DNA, 739 bp, Artificial Sequence
  Synthetic polypeptide
gaggtaacagagtgaagtaaaaagcactgatttcacagtctgaatattgaatcatgtcctatctttgtccctaactgacattatgatcttgatcacttaccctttctgggctgcagttttgtggtctatagattggttataataatatccactatacctacataccagaatcgaaggctcaaataaaatcatggactttgcctcccgggccaaactggcagttcaaaaactagtacagaaagttggattttttggaattttggcctgtgcttcaattccaaatcctttatttgatctggctggaataacgtgtggacactttctggtacctttttggaccttctttggtgcaaccctaattggaaaagcaataataaaaatgcatatccagaaaatttttgttataataacattcagcaagcacatagtggagcaaatggtggctttcattgggctggaggacaatggcgcactgcaacctccacctcccagtgctgtccccggcataggtccatctctgcagaagccatttcaggagtacctggaggctcaacggcagaagcttcaccacaaaagcgaaatgggcacaccacagggagaaaactggttgtcctggatgtttgaaaagttggtcgttgtcatggtgtgttacttcatcctatctatcattaactccatggcacaaagttatgccaaacgaatccagcagcggttgaactcagaggagaaaactaaataa

SEQ ID NO: 14590 - DNA, 342 bp, Artificial Sequence; identical to SEQ ID NO: 7076
  Synthetic polypeptide

SEQ ID NO: 14591 - DNA, 1516 bp, Artificial Sequence; identical to SEQ ID NO: 7077
  Synthetic polypeptide

SEQ ID NO: 14592 - DNA, 1444 bp, Artificial Sequence; identical to SEQ ID NO: 7078
  Synthetic polypeptide

SEQ ID NO: 14593 - DNA, 1312 bp, Artificial Sequence; identical to SEQ ID NO: 7079
  Synthetic polypeptide

SEQ ID NO: 14594 - DNA, 74 bp, Artificial Sequence; identical to SEQ ID NO: 7010
  Synthetic polypeptide

SEQ ID NO: 14595 - DNA, 471 bp, Artificial Sequence; identical to SEQ ID NO: 10499
  Synthetic polypeptide

SEQ ID NO: 14596 - DNA, 395 bp, Artificial Sequence; identical to SEQ ID NO: 10500
  Synthetic polypeptide

SEQ ID NO: 14597 - DNA, 130 bp, Artificial Sequence
  Synthetic polypeptide
ttggcaaagcaactactagaactgagaagggaatatagcaaggctggctgaaggcggtgcaggtcctcatggtgctctccctcattctctgctgtctctccttcatcctgttcatgttccagctctacac

SEQ ID NO: 14598 - DNA, 353 bp, Artificial Sequence
  Synthetic polypeptide
ttggcaaagcaactactagaactgagaagggaatatagcaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtga

SEQ ID NO: 14599 - DNA, 407 bp, Artificial Sequence
  Synthetic polypeptide
ttggcaaagcaactactagaactgagaagggaatatagcaaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcg

SEQ ID NO: 14600 - DNA, 2157 bp, Artificial Sequence; identical to SEQ ID NO: 6426
  Synthetic polypeptide

SEQ ID NO: 14601 - DNA, 799 bp, Artificial Sequence; identical to SEQ ID NO: 6427
  Synthetic polypeptide

SEQ ID NO: 14602 - DNA, 336 bp, Artificial Sequence; identical to SEQ ID NO: 6428
  Synthetic polypeptide

SEQ ID NO: 14603 - DNA, 3477 bp, Artificial Sequence
  Synthetic polypeptide
ggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagttaccactacaacgacctggtgtctccacagtacctgaacctcatcgcaaacctgtcgggctgtaccgcccaccggcgcgtgaacaactgctcggacatgtgcttccaccagaagtaccggacgcacgacggcacctgtaacaacctgcagcaccccatgtggggcgcctcgctgaccgccttcgagcgcctgctgaaatccgtgtacgagaatggcttcaacacccctcggggcatcaacccccaccgactgtacaacgggcacgcccttcccatgccgcgcctggtgtccaccaccctgatcgggacggagaccgtcacacccgacgagcagttcacccacatgctgatgcagtggggccagttcctggaccacgacctcgactccacggtggtggccctgagccaggcacgcttctccgacggacagcactgcagcaacgtgtgcagcaacgaccccccctgcttctctgtcatgatcccccccaatgactcccgggccaggagcggggcccgctgcatgttcttcgtgcgctccagccctgtgtgcggcagcggcatgacttcgctgctcatgaactccgtgtacccgcgggagcagatcaaccagctcacctcctacatagacgcatccaacgtgtacgggagcacggagcatgaggcccgcagcatccgcgacctggccagccaccgcggcctgctgcggcagggcatcgtgcagcggtccgggaagccgctgctccccttcgccaccgggccgcccacggagtgcatgcgggacgagaacgagagccccatcccctgcttcctggccggggaccaccgcgccaacgagcagctgggcctgaccagcatgcacacgctgtggttccgcgagcacaaccgcattgccacggagctgctcaagctgaacccgcactgggacggcgacaccatctactatgagaccaggaagatcgtgggtgcggagatccagcacatcacctaccagcactggctcccgaagatcctgggggaggtgggcatgaggacgctgggagagtaccacggctacgaccccggcatcaatgctggcatcttcaacgccttcgccaccgcggccttcaggtttggccacacgcttgtcaacccactgctttaccggctggacgagaacttccagcccattgcacaagatcacctcccccttcacaaagctttcttctctcccttccggattgtgaatgagggcggcatcgatccgcttctcagggggctgttcggggtggcggggaaaatgcgtgtgccctcgcagctgctgaacacggagctcacggagcggctgttctccatggcacacacggtggctctggacctggcggccatcaacatccagcggggccgggaccacgggatcccaccctaccacgactacagggtctactgcaatctatcggcggcacacacgttcgaggacctgaaaaatgagattaaaaaccctgagatccgggagaaactgaaaaggttgtatggctcgacactcaacatcgacctgtttccggcgctcgtggtggaggacctggtgcctggcagccggctgggccccaccctgatgtgtcttctcagcacacagttcaagcgcctgcgagatggggacaggttgtggtatgagaaccctggggtgttctccccggcccagctgactcagatcaagcagacgtcgctggccaggatcctatgcgacaacgcggacaacatcacccgggtgcagagcgacgtgttcagggtggcggagttccctcacggctacggcagctgtgacgagatccccagggtagacctccgggtgtggcaggactgctgtgaagactgtaggaccagggggcagttcaatgccttttcctatcatttccgaggcagacggtctcttgagttcagctaccaggaggacaagccgaccaagaaaacaagaccacggaaaatacccagtgttgggagacagggggaacatctcagcaacagcacctcagccttcagcacacgctcagatgcatctgggacaaatgacttcagagagtttgttctggaaatgcagaagaccatcacagacctcagaacacagataaagaaacttgaatcacggctcagtaccacagagtgcgtggatgccgggggcgaatctcacgccaacaacaccaagtggaaaaaagatgcatgcaccatttgtgaatgcaaagacgggcaggtcacctgcttcgtggaagcttgcccccctgccacctgtgctgtccccgtgaacatcccaggggcctgctgtccagtctgcttacagaagagggcggaggaaaagccctag

SEQ ID NO: 14604 - DNA, 1221 bp, Artificial Sequence
  Synthetic polypeptide
ggctgacacactgcagcctgcagtccacacctgcctactgcctgtttttcctaagctcgacccacttttgtaatccagccacagaatacagaggtgctggttggggagagcgtcacgctggagtgcagcgccacaggccaccccccgccgcggatctcctggacgagaggtgaccgcacacccttgccagttgacccgcgggtgaacatcacgccttctggcgggctttacatacagaacgtcgtacagggggacagcggagagtatgcgtgctctgcgaccaacaacattgacagcgtccatgccaccgctttcatcatcgtccaggctcttcctcagttcactgtgacgcctcaggacagagtcgttattgagggccagaccgtggatttccagtgtgaagccaagggcaacccgccgcccgtcatcgcctggaccaagggagggagccagctctccgtggaccggcggcacctggtcctgtcatcgggaacacttagaatctctggtgttgccctccacgaccagggccagtacgaatgccaggctgtcaacatcatcggctcccagaaggtcgtggcccacctgactgtgcagcccagagtcaccccagtgtttgccagcattcccagcgacacaacagtggaggtgggcgccaatgtgcagctcccgtgcagctcccagggcgagcccgagccagccatcacctggaacaaggatggggttcaggtgacagaaagtggaaaatttcacatcagccctgaaggattcttgaccatcaatgacgttggccctgcagacgcaggtcgctatgagtgtgtggcccggaacaccattgggtcggcctcggtgagcatggtgctcagtgtgaatgttcctgacgtcagtcgaaatggagatccgtttgtagctacctccatcgtggaagcgattgcgactgttgacagagctataaactcaacccgaacacatttgtttgacagccgtcctcgttctccaaatgatttgctggccttgttccggtatccgagggatccttacacagttgaacaggcacgggcgggagaaatctttgaacggacattgcagctcattcaggagcatgtacagcatggcttgatggtcgacctcaacggaacaagtcagtgccaaagccttttcttcctcctccatggcctgagtaacggggttgaacacgcctcagttaagtcacattcctag

SEQ ID NO: 14605 - DNA, 708 bp, Artificial Sequence
  Synthetic polypeptide
tgtacagaaaagagttaacataacaagcctgagaccgctcttcttaaaaaggcttgctggcaaggctgggccttggctggcttctgggaacttggattttgtgggtatttgtactactctaactgataagagtggttcactgtgcctaaactgtttgtgtaaacattgtggtttaggctgaacatctgctttccttctgagagtctggaatcttggtacgtgctaggcagagggtgcctaagtgaccagcccccagtagagaactttcacagtgagtgtctaatgagtttccctggtagaaaacacttcacacatgtcataattccatgctggaagaattaagtgcatcctgtgactctaccgggaggactcttgaaaatcagcacctgatttcctctggacttttccctttgatgatttttctttgtatccttttgctgtaataaatcatagccatgggtatgactatacgctgagtcctgctaatgaatcactgaacctggaaggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctag

SEQ ID NO: 14606 - DNA, 2578 bp, Artificial Sequence; identical to SEQ ID NO: 7194
  Synthetic polypeptide

SEQ ID NO: 14607 - DNA, 2305 bp, Artificial Sequence; identical to SEQ ID NO: 7195
  Synthetic polypeptide

SEQ ID NO: 14608 - DNA, 1759 bp, Artificial Sequence; identical to SEQ ID NO: 7196
  Synthetic polypeptide

SEQ ID NO: 14609 - DNA, 1880 bp, Artificial Sequence
  Synthetic polypeptide
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacactccagactatgactcctttacactggacagctacacttggcccaaggaagccatgaatgttcagacggtctga

SEQ ID NO: 14610 - DNA, 1807 bp, Artificial Sequence
  Synthetic polypeptide
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggcacagcctccgttgctgtggcagggatcttggctgctctgcgaatcaccaagaacaagctttccaatcacgtgtttgttttccaaggtgcaggcgaggcagctatgggcattgcccacctccttgtcatggccctagagaaagaaggtgtaccgaaggcagaggccacaagaaagatctggatggtggactctaaagggctcattgtcaaggggaggagccacctgaaccatgaaaaggagatgtttgcccaagaccatcctgaagtcaactccctggaggaggtggtgaggctggtgaagcccacagccatcataggtgttgctgccatcgcaggagccttcacggagcagattctgagggacatggcctccttccacgagcgccctatcatctttgccctgagcaaccccaccagcaaggccgagtgcacggctgagaagtgctaccgggtcaccgagggccgagggatttttgccagtggaagtccttttaagagtgtgactctggaagatggcaagaccttcattcctgggcagggaaacaatgcttacgtgttccccggggtggcactgggagtcatcgccggcgggatccggcacatcccagatgagatcttcctcctgacagcagagcaaattgcccaggaagtctctgagcagcatctgtcccaggggagactctacccaccactcagcaccatccgagacgtgtctttgagaattgccatcaaagttctcgactacgcgtacaaacacaacctggcttcctactacccagagcctaaggacaaggaggcttttgtaagatccctggtctacac

SEQ ID NO: 14611 - DNA, 1094 bp, Artificial Sequence
  Synthetic polypeptide
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgactttccgcaggccccgtggactgttcatcaccattcatgacaaaggtcatcttgcaacaatgctgaattcttggccagaagacaatattaaggccgtggtggtgactgatggggagcgcatcctgggcctgggagacctgggctgctacggcatgggcatccctgtgggcaagctggccctgtacacggcatgcggaggggtgaacccgcagcagtgcctccctgtgctgctggacgtcggcaccaacaatgaggagctgctcagagaccctctgtacatcggcctgaaacaccagcgcgtgcacgggaaggcatacgatgacttgctggatgagttcatgcaggctgtgacagacaagtttggaataaattgcctcatccaatttgaagacttcgccaatgccaatgccttccgcctgctcaacaaataccgtaacaagtactgcatgttcaatgatgacatccaaggaacaacctgccacactttcagctgcccatggcatttatgggcacaagtcatgttccagcacatccctggacccatgggcttctcagagtggttacctcgaaacagctaa

SEQ ID NO: 14612 - DNA, 520 bp, Artificial Sequence
  Synthetic polypeptide
tgatatggtttggctgtgtccccatacaaatctcatcttgaattataatccccataatccccacgtgttgtggaaggaaccctgtgggaggtaattgaatcacgggggtggttcccctgcatgctgttctcgtgataatgaatgagttctcacgagacctgatggttttataagtgcctgacacatttcccctgctagcgctcattctctctcctgccaccctctgaggaggtgccttcgccatgattgggatggcctttacccttgaagaaaggctgcagcttggaatccacggcctaatcccgccctgctttctgagccaggacgtccagctcctccgaatcatgagatattacgagcggcagcagagtgacctggacaagtacatcattctcatgacactccaagaccggaacgagaagctcttctaccgagtgctgacttcggacgtggagaagttcatgccaatcgtgtacacgcctaccgtggggctggcctgtcagcactatggcctgacttt

SEQ ID NO: 14613 - DNA, 216 bp, Artificial Sequence
  Synthetic polypeptide
agccagatttcagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctag

SEQ ID NO: 14614 - DNA, 367 bp, Artificial Sequence; identical to SEQ ID NO: 548
  Synthetic polypeptide

SEQ ID NO: 14615 - DNA, 1017 bp, Artificial Sequence
  Synthetic polypeptide
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatga

SEQ ID NO: 14616 - DNA, 579 bp, Artificial Sequence
  Synthetic polypeptide
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtgctgtga

SEQ ID NO: 14617 - DNA, 486 bp, Artificial Sequence
  Synthetic polypeptide
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagtatatctcagagatgttgcaggtcttgttccagaccaccacaataa

SEQ ID NO: 14618 - DNA, 613 bp, Artificial Sequence
  Synthetic polypeptide
tggtaggcagaacagtggcctgccaaaagtgtccacatcctaattcctggaacctgtaaatatgttacttttcctgccaaaaggaactttgctggtgtgactaacaccagcaaaattaaagatcttgagatgggaagattatcctggattatctggctaggtccaattgaagatccttataaatgaaagatggaggtaggtccgagtcagagtgacttgataagagaaggattcaatccaccattgctggccttgaagacagaaggggaccactagtcaaggaatgtagtcagcttccagaagcttgaaaaggcaaagaaattgatttttccctaaagcttccagaagtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccac

SEQ ID NO: 14619 - DNA, 435 bp, Artificial Sequence; identical to SEQ ID NO: 11492
  Synthetic polypeptide

SEQ ID NO: 14620 - DNA, 351 bp, Artificial Sequence; identical to SEQ ID NO: 11493
  Synthetic polypeptide

SEQ ID NO: 14621 - DNA, 947 bp, Artificial Sequence; identical to SEQ ID NO: 6434
  Synthetic polypeptide

SEQ ID NO: 14622 - DNA, 881 bp, Artificial Sequence; identical to SEQ ID NO: 6435
  Synthetic polypeptide

SEQ ID NO: 14623 - DNA, 1170 bp, Artificial Sequence
  Synthetic polypeptide
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaagatgaggaaactgaggctcagagaggtgaagtacctggcccaaggccacacagccagaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataacaaagacctaa

SEQ ID NO: 14624 - DNA, 1104 bp, Artificial Sequence
  Synthetic polypeptide
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagcctgtgtgcatggcgggaagacgtactcccacggggaggtgtggcacccggccttccgtgccttcggccccttgccctgcatcctatgcacctgtgaggatggccgccaggactgccagcgtgtgacctgtcccaccgagtacccctgccgtcaccccgagaaagtggctgggaagtgctgcaagatttgcccagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaaggaatcttccacttgactcagatcaagaaagtcaggaagcaagacttccagaaagaggcacagcacttccgactgctcgctggcccccacgaaggtcactggaacgtcttcctagcccagaccctggagctgaaggtcacggccagtccagacaaagtgaccaagacataa

SEQ ID NO: 14625 - DNA, 303 bp, Artificial Sequence
  Synthetic polypeptide
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacaatgaggcaagtgagcaatcggatgaagaggacagtgtgcagtcgctccatggggtga

SEQ ID NO: 14626 - DNA, 739 bp, Artificial Sequence
  Synthetic polypeptide
cgggccctgggcgcccatgtgagttgttaccgcctccactgtccgcctgtccactgcccccagcctgtgacggagccacagcaatgctgtcccaagtgtgtggaacctcacactccctctggactccgggccccaccaaagtcctgccagcacaacgggaccatgtaccaacacggagagatcttcagtgcccatgagctgttcccctcccgcctgcccaaccagtgtgtcctctgcagctgcacagagggccagatctactgcggcctcacaacctgccccgaaccaggctgcccagcacccctcccgctgccagactcctgctgccaggcctgcaaagatgaggcaagtgagcaatcggatgaagaggacagtgtgcagtcgctccatggggtgagacatcctcaggatccatgttccagtgatgctgggagaaagagaggcccgggcaccccagcccccactggcctcagcgcccctctgagcttcatccctcgccacttcagacccaagggagcaggcagcacaactgtcaagatcgtcctgaaggagaaacataagaaagaggacaaagcagaccctggccacagtgagatcagttctaccaggtgtcccaaggcaccgggccgggtcctcgtccacacatcggtatccccaagcccagacaacctgcgtcgctttgccctggaacacgaggcctcggacttggtggagatctacctctggaagctggtaaaag

SEQ ID NO: 14627 - DNA, 500 bp, Artificial Sequence
  Synthetic polypeptide
agtagtcctcccttatctgtggtttcagttacccatggttcagtgaggtccaacaatattcagtgaaaaattccataaataaacaactgatacgttttgaattgcatgccgttcttagtagtgtgatgaaatctcgcgccacccagctccatcctgcccgggatgtgaatcatccttttgtccatcgtattcctgctgtagacatgactcaacccacccatcacttagcagccgtctgggttatcagattgactgtcatagcggcacagtgcttgtgttcaagcaacccttattttacttcccgatggccccaaagtgcaagagtagcgacgctggtgattccgacatgccagaaagaggctgcaaagtgcttcctgtaagcgaaaagctgaaagttctcaatgtaataaggaaagaaaaagaaatcatatgctgaggttgctaagatctatggtactcagggagttttgagattttccaagatgccatcgaggaactga

SEQ ID NO: 14628 - DNA, 956 bp, Artificial Sequence
  Synthetic polypeptide
gtggtaccaggaaggcagcagcttggtgtcatgggacaagccacgccaaggccaaagctgaggcagcggaacaggccgccctggctgccaaccaggagtccaacattgctcgcactttggccagggagctggctccggacttctaccagccaggtccggaatatcagaagcgccggctgctgcaggagatcctggagaactcggagagcctgctggagccccccgaccggggcgccggcgcagcgggcctcccacagccgccccgcgagagcccgcagctgcacgagcgtgagacccctcggcccgagggtggctccccgtcaccggccgggacgcccccgcagcccaagcggcccaggcccggggtgtccaaggacggcctgctgagcccaggcgcctggaacggcgagcccagcggtgagggcagccggtcagtcactccgtccgagggcgcgggccgccgcagccccgcgcgtccagccaccgagcgcatggccatcgaggctctgcaggcaccgcctgcgccgtcgcgggagccggaggtggcgctttaccagggctaccacagctatgctgtgcgcaccacgccgcccgagcccccaccctttgaggaccagcccgagcccgaggtctccgggtccgagtccgcgccctcgtccccggccaccgccccgctgcaggcccccacgctccgaggccccgagcctgcacgcgagacccccgccaagctggagcccaagcccatcatccccaaagccgagcccagggccaaggcccgcaagactgaggctcgagggctgaccaaggcgggggccaagaagaaggcgcggaaggaggccgcactggcggcagaggcggaggtggaggtggaagaggtccccaacaccatcctcatctgcatggtgatcctgctgaacatcggcctggccatcctctttgttcacctcctgacctga

SEQ ID NO: 14629 - DNA, 662 bp, Artificial Sequence; identical to SEQ ID NO: 10265
  Synthetic polypeptide

SEQ ID NO: 14630 - DNA, 1516 bp, Artificial Sequence; identical to SEQ ID NO: 534
  Synthetic polypeptide

SEQ ID NO: 14631 - DNA, 591 bp, Artificial Sequence; identical to SEQ ID NO: 539
  Synthetic polypeptide

SEQ ID NO: 14632 - DNA, 482 bp, Artificial Sequence; identical to SEQ ID NO: 540
  Synthetic polypeptide

SEQ ID NO: 14633 - DNA, 444 bp, Artificial Sequence; identical to SEQ ID NO: 541
  Synthetic polypeptide

SEQ ID NO: 14634 - DNA, 334 bp, Artificial Sequence; identical to SEQ ID NO: 533
  Synthetic polypeptide

SEQ ID NO: 14635 - DNA, 38 bp, Artificial Sequence; identical to SEQ ID NO: 543
  Synthetic polypeptide

SEQ ID NO: 14636 - DNA, 245 bp, Artificial Sequence; identical to SEQ ID NO: 542
  Synthetic polypeptide

SEQ ID NO: 14637 - DNA, 517 bp, Artificial Sequence; identical to SEQ ID NO: 7016
  Synthetic polypeptide

SEQ ID NO: 14638 - DNA, 1114 bp, Artificial Sequence; identical to SEQ ID NO: 9614
  Synthetic polypeptide

SEQ ID NO: 14639 - DNA, 971 bp, Artificial Sequence
  Synthetic polypeptide
tgcctgcctggcggttctgaagatcaaatgaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtag

SEQ ID NO: 14640 - DNA, 410 bp, Artificial Sequence
  Synthetic polypeptide
tgcctgcctggcggttctgaagatcaaatgaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcag

SEQ ID NO: 14641 - DNA, 1901 bp, Artificial Sequence; identical to SEQ ID NO: 7113
  Synthetic polypeptide

SEQ ID NO: 14642 - DNA, 1739 bp, Artificial Sequence; identical to SEQ ID NO: 7114
  Synthetic polypeptide

SEQ ID NO: 14643 - DNA, 1859 bp, Artificial Sequence; identical to SEQ ID NO: 7115
  Synthetic polypeptide

SEQ ID NO: 14644 - DNA, 1616 bp, Artificial Sequence; identical to SEQ ID NO: 7116
  Synthetic polypeptide

SEQ ID NO: 14645 - DNA, 501 bp, Artificial Sequence; identical to SEQ ID NO: 7117
  Synthetic polypeptide

SEQ ID NO: 14646 - DNA, 369 bp, Artificial Sequence; identical to SEQ ID NO: 7118
  Synthetic polypeptide

SEQ ID NO: 14647 - DNA, 1731 bp, Artificial Sequence; identical to SEQ ID NO: 6691
  Synthetic polypeptide

SEQ ID NO: 14648 - DNA, 2019 bp, Artificial Sequence; identical to SEQ ID NO: 6692
  Synthetic polypeptide

SEQ ID NO: 14649 - DNA, 2043 bp, Artificial Sequence; identical to SEQ ID NO: 6693
  Synthetic polypeptide

SEQ ID NO: 14650 - DNA, 554 bp, Artificial Sequence; identical to SEQ ID NO: 6694
  Synthetic polypeptide

SEQ ID NO: 14651 - DNA, 853 bp, Artificial Sequence; identical to SEQ ID NO: 9052
  Synthetic polypeptide

SEQ ID NO: 14652 - DNA, 265 bp, Artificial Sequence; identical to SEQ ID NO: 9053
  Synthetic polypeptide

SEQ ID NO: 14653 - DNA, 4410 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14654 - DNA, 4155 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14655 - DNA, 324 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaa

SEQ ID NO: 14656 - DNA, 842 bp, Artificial Sequence; identical to SEQ ID NO: 6534
  Synthetic polypeptide

SEQ ID NO: 14657 - DNA, 493 bp, Artificial Sequence; identical to SEQ ID NO: 12530
  Synthetic polypeptide

SEQ ID NO: 14658 - DNA, 970 bp, Artificial Sequence; identical to SEQ ID NO: 711
  Synthetic polypeptide

SEQ ID NO: 14659 - DNA, 423 bp, Artificial Sequence; identical to SEQ ID NO: 6550
  Synthetic polypeptide

SEQ ID NO: 14660 - DNA, 456 bp, Artificial Sequence; identical to SEQ ID NO: 6649
  Synthetic polypeptide

SEQ ID NO: 14661 - DNA, 480 bp, Artificial Sequence; identical to SEQ ID NO: 6650
  Synthetic polypeptide

SEQ ID NO: 14662 - DNA, 186 bp, Artificial Sequence; identical to SEQ ID NO: 6651
  Synthetic polypeptide

SEQ ID NO: 14663 - DNA, 1025 bp, Artificial Sequence; identical to SEQ ID NO: 6438
  Synthetic polypeptide

SEQ ID NO: 14664 - DNA, 857 bp, Artificial Sequence; identical to SEQ ID NO: 6439
  Synthetic polypeptide

SEQ ID NO: 14665 - DNA, 581 bp, Artificial Sequence; identical to SEQ ID NO: 6440
  Synthetic polypeptide

SEQ ID NO: 14666 - DNA, 317 bp, Artificial Sequence; identical to SEQ ID NO: 6441
  Synthetic polypeptide

SEQ ID NO: 14667 - DNA, 369 bp, Artificial Sequence; identical to SEQ ID NO: 6492
  Synthetic polypeptide

SEQ ID NO: 14668 - DNA, 853 bp, Artificial Sequence; identical to SEQ ID NO: 10246
  Synthetic polypeptide

SEQ ID NO: 14669 - DNA, 3222 bp, Artificial Sequence
  Synthetic polypeptide
tgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 14670 - DNA, 1287 bp, Artificial Sequence
  Synthetic polypeptide
tgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgggcctccctggacagcctggacagcctcagccgcgccctgggcgtcctagaggagcacgccaacagctcgaggcggagggcacgcaggcatgctgcggacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 14671 - DNA, 3545 bp, Artificial Sequence; identical to SEQ ID NO: 8594
  Synthetic polypeptide

SEQ ID NO: 14672 - DNA, 3542 bp, Artificial Sequence; identical to SEQ ID NO: 8595
  Synthetic polypeptide

SEQ ID NO: 14673 - DNA, 1628 bp, Artificial Sequence; identical to SEQ ID NO: 8596
  Synthetic polypeptide

SEQ ID NO: 14674 - DNA, 557 bp, Artificial Sequence; identical to SEQ ID NO: 6591
  Synthetic polypeptide

SEQ ID NO: 14675 - DNA, 372 bp, Artificial Sequence
  Synthetic polypeptide
gatatggtttagatctgtgtttccacaaaattgcattacaaattataatccccagtgttggaggtggggcctggtgggaggtgactggatcatgggggtggtttctcatggatggtttagcaccatccccctagtgctgttcttgtgatagagttctcatgagatctgattgtttaaaagtgcgtgacatctccctgctctctctcttcctactgctcctggccatgtgaggtgctggctcacccttcaccttccatcagtattgtaagtttcctgagacctccccagaagctgagcagatgccagaatcatgcttcctgcaaagcctgcagaattcagggagataccagggttcgtcatgggcagcaatga

SEQ ID NO: 14676 - DNA, 677 bp, Artificial Sequence; identical to SEQ ID NO: 747
  Synthetic polypeptide

SEQ ID NO: 14677 - DNA, 674 bp, Artificial Sequence; identical to SEQ ID NO: 748
  Synthetic polypeptide

SEQ ID NO: 14678 - DNA, 395 bp, Artificial Sequence
  Synthetic polypeptide
tgtgatagttaatactgagtggattgaaggatacaaagtactgatcttgggtgtgtctgtgagggtgttgccaaaagagattaacatttgagtcaggctagggaaggcagacccacccttgatctgggtgggcacaatctaatcagctgccagtgcagctagaatataagcaggaaaaaaaaatgtgaaaaagaaagactaacagcctcccagcctacatctttctcccatgctggttgcttgctgctcttgaacatcagactccaggttcttcagttttgggactcggactggctctccttgctcctgaacttgaagacagcctattgtgagactttgtgatcatgctggcactgatcccagtttatcctttgagattcagcagaagatcctga

SEQ ID NO: 14679 - DNA, 497 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggagcttctga

SEQ ID NO: 14680 - DNA, 491 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcggtga

SEQ ID NO: 14681 - DNA, 929 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccaggtgaaggctcgggaggcgagtctgctggaggtggagacaaagtctctgaaactggaacattcctgatctctccccacacagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 14682 - DNA, 545 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgcccagcaggagcttctgaacatgaagctatggaccatccacgagctgctgcaagatag

SEQ ID NO: 14683 - DNA, 437 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcaggtgggtttagcagaagtctgtgctgggtcgggggagtttag

SEQ ID NO: 14684 - DNA, 848 bp, Artificial Sequence
  Synthetic polypeptide
gaccgggcgcggtgtcacgcctgtaatcccagcactttgggagggcgaggtggactgatcgcttgacaccaggcgttcgagaccagcctgggcaacaggtgaaaatccgtctctacaaaaaatacaaaaattagccaggcatgatggcgtgcgcctgcggtcccaactacttgggagcctgagggaacgcagcccaccccggctctggagccacggaaccccggcggcgaccaccgctcaaggatcaacgcgagcggacccgggccgggtcgctgcctctgggggcgctgtacaccgcggccgtcgcggcttttgtgctgtacaagtgtttgcaggggaaagatgaaactgcggttctccacgaggaggcaagcaagcagcagccactgcagtcagagcaacagctggcccagttgacacaacagctggcccagacagagcagcacctgaacaacctgatggcccagctggaccccctttttgagcgtgtgactactctggctggagcccagcaggagcttctgaacatgaagctatggaccatccacgagctgctgcaagatagcaagccggacaaggatatggaggcttcagaaccagaggccagcagacctcttcctgaggacttctgtttaaaggaggacgaggaggagattggtgacagtcaggcctgggaggagcccacaaactggagcacagagacatggaacctagctacttcctgggaggtggggcggggactacggagaaggtgcagccaggctgtggcaaagggccccagtcacagccttggctgggaaggagggacgacagctgaaggtcgactaaaacaaagtctgttttcatga

SEQ ID NO: 14685 - DNA, 2387 bp, Artificial Sequence; identical to SEQ ID NO: 7139
  Synthetic polypeptide

SEQ ID NO: 14686 - DNA, 1478 bp, Artificial Sequence; identical to SEQ ID NO: 7140
  Synthetic polypeptide

SEQ ID NO: 14687 - DNA, 567 bp, Artificial Sequence
  Synthetic polypeptide
tatgatggttaatattgaatgtcatcttgattggattgaaggatgcaaagtattgtttctgggtgtgtctgtaagggtattgccaaaggagattaacatttgagtcagtggactgggaaaggcagatcaaccctcaatatgagtgggcaccatccaatcagctaccagcatgggtagaataaagcaggcagaagaggtggagagattagactggcttagcctcccagccaacatcttactcccgtgcttgatgtttcctgacctcgaacatcgaactccaggttcttaggctttgggactccgactggcttccttgttcctcagcttgcagatggactattgagggaccttgtgatcatggaaaaaaacaaaccaaccaacaaactgagcctgaaactgataacacagatacgtacagcatcatatttaagtaaccaatcggaattattgcagtggagatgttttattggtgggaaatacggtatcacaccatttcagacatcaggagataattatccctgtcttctcggaaccagcttcttcaaaggagtcaggaattatttatga

SEQ ID NO: 14688 - DNA, 1797 bp, Artificial Sequence; identical to SEQ ID NO: 7070
  Synthetic polypeptide

SEQ ID NO: 14689 - DNA, 1081 bp, Artificial Sequence; identical to SEQ ID NO: 7071
  Synthetic polypeptide

SEQ ID NO: 14690 - DNA, 1059 bp, Artificial Sequence; identical to SEQ ID NO: 7072
  Synthetic polypeptide

SEQ ID NO: 14691 - DNA, 909 bp, Artificial Sequence; identical to SEQ ID NO: 7073
  Synthetic polypeptide

SEQ ID NO: 14692 - DNA, 622 bp, Artificial Sequence
  Synthetic polypeptide
gctgggcgcagtggctcacgtctgtaatcccagcagtttgggaggccaagacgagcagatcacctgaggtcaggagttcaagaccagtctggccaacatgctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctga

SEQ ID NO: 14693 - DNA, 1388 bp, Artificial Sequence
  Synthetic polypeptide
ggctgggcgcagtggctcacgcctgtaatcccagcactttgggaggccaaggcgggcagatcacctgaggtcgggagtttgagaccagcttgaccaacatggagaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctgatttagaagaggaatcagaaagctgggacaactctgaggctgaagaggaggagaaagcccctgtgttgccagagagtacagaagggcgggagctgacccagggcccggcagagtcctcctctctctcaggctgtgggagctggcagccccggaagctgccagtcttcaagtccctccggcacatgaggcaggtcctgggtgccccttctttccgcatgctggcctggcacgttctcatggggaaccaggtgatctggaaaagcagagacgtggacctcgtccagtcagcttttgaagtacttcggaccatgcttcccgtgggctgcgtccgcatcatcccatacagcagccagtacgaggaggcctatcggtgcaacttcctggggctcagcccgcacgtgcagatccccccccacgtgctctcctcagagtttgctgtcatcgtggaggtccacgcagccgcacgttccaccctccaccctgtggggtgtgaggatgaccagtctctcagcaagtacgagtttgtggtgaccagtgggagccctgtagctgcagaccgagtgggccccaccatcctgaataagattgaagcggctctgaccaaccagaacctgtctgtggatgtggtggaccagtgcctcgtctgcctcaaggaggagtggatgaacaaagtgaaggtgctttttaagttcaccaaggtggacagtcgacccaaagaggacacacagaagctgctgagcatcctgggtgcgtccgaggaggacaatgtcaagctgctgaagttctggatgactggcctgagcaagacctacaagtcacacctcatgtccacggtccgcagccccacagcctcggagtctcggaactga

SEQ ID NO: 14694 - DNA, 677 bp, Artificial Sequence
  Synthetic polypeptide
ggctgggcgcagtggctcacgcctgtaatcccagcactttgggaggccaaggcgggcagatcacctgaggtcgggagtttgagaccagcttgaccaacatggagaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggctcctgaaggcgtgtggcagccggctgaccgagaagctcctggaaggtgctccgaccgaggataccttggtccagatggagaagctcgctggtgaggcaggggtgctgttgccggggccttggcccggatggccgtggggcggtaccagctgtctgctctcctggcaggaatcgctgagggagggaaacgcggctctgaatcagcccagaacgagccttcgggaagctcaccctccgatctcggtgtga

SEQ ID NO: 14695 - DNA, 1002 bp, Artificial Sequence; identical to SEQ ID NO: 13329
  Synthetic polypeptide

SEQ ID NO: 14696 - DNA, 463 bp, Artificial Sequence; identical to SEQ ID NO: 11344
  Synthetic polypeptide

SEQ ID NO: 14697 - DNA, 2000 bp, Artificial Sequence
  Synthetic polypeptide
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttga

SEQ ID NO: 14698 - DNA, 391 bp, Artificial Sequence
  Synthetic polypeptide
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctga

SEQ ID NO: 14699 - DNA, 576 bp, Artificial Sequence
  Synthetic polypeptide
tgctatggttcgaatgtttctcccctccaaaactcatgttgaaactaaatctcttttttaacagaattaaggaggtgggaaatctgactacggtatttgagagatgggaccttgagcggtaattaggattagattagatgaggtcataagggtggggcattagtggttttctaagaggagaaacagatctgagctagcaaggtcagcacccttaccatgtgatgccctgctctgcctcgccactccacagagaggccccaccagcagaaggccctcaccagatgtgactccttgaccatggacttcccagcctccagaactgcccattgctagaagactgggacataatcagccccaaagatgtcattggctccgacgtgttgctggctgagaaacggtcatcactgacgactgccgccctgccctttacacagtccatcctcactcaggtgggccgtaccttgtctaaggtccaacaagtgctgagctggtcgtatggggaagatgtcaagcccttcaagccacccctgagcgatgctgagtttcacacgtacctgaaccacgagggccagctct

SEQ ID NO: 14700 - DNA, 670 bp, Artificial Sequence
  Synthetic polypeptide
gcaaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctatcaccccgtgctgccctccgtcctcgccacctgctcctggggaggggacatgaagatctggcactga

SEQ ID NO: 14701 - DNA, 53 bp, Artificial Sequence
  Synthetic polypeptide
gcaaggaacccagctatttagtggtcgaagtgactttagaatcactaccttga

SEQ ID NO: 14702 - DNA, 331 bp, Artificial Sequence; identical to SEQ ID NO: 8434
  Synthetic polypeptide

SEQ ID NO: 14703 - DNA, 1538 bp, Artificial Sequence; identical to SEQ ID NO: 8435
  Synthetic polypeptide

SEQ ID NO: 14704 - DNA, 884 bp, Artificial Sequence; identical to SEQ ID NO: 8436
  Synthetic polypeptide

SEQ ID NO: 14705 - DNA, 343 bp, Artificial Sequence; identical to SEQ ID NO: 8437
  Synthetic polypeptide

SEQ ID NO: 14706 - DNA, 401 bp, Artificial Sequence; identical to SEQ ID NO: 8438
  Synthetic polypeptide

SEQ ID NO: 14707 - DNA, 1535 bp, Artificial Sequence; identical to SEQ ID NO: 8439
  Synthetic polypeptide

SEQ ID NO: 14708 - DNA, 255 bp, Artificial Sequence; identical to SEQ ID NO: 8440
  Synthetic polypeptide

SEQ ID NO: 14709 - DNA, 88 bp, Artificial Sequence; identical to SEQ ID NO: 8441
  Synthetic polypeptide

SEQ ID NO: 14710 - DNA, 429 bp, Artificial Sequence; identical to SEQ ID NO: 8442
  Synthetic polypeptide

SEQ ID NO: 14711 - DNA, 996 bp, Artificial Sequence
  Synthetic polypeptide
attttggccatatataaaaattctaaatcggtcagagacctaaatgtaaaacctagaactataaaaattttagaacaaaacataggagagaatctttgtgatcttggattaggcaaagatttcttaaatatgataccaaaaaaagaacaatccattaacaaattgataaattgggcttcatcaaaattaaaaactgctcttcccaagacaatattaggagacagaaaagacaaacaagagactgggaaaaaaaatctttgtaaagcatatgtttgataaaagatttgcatccaaaatatataaagtgttctaagctcaataatgaaacaactcaacattaaatgggcaaaagatctgaacggacacttcaccaaggaaaatacactcgctgcaaatacgcacatgaaaagatgcttaacatcattaacgattagagaatgcataataaagccacaatgagctaccactacacagaaccggaacatctacagttaaaatctctggactttcaagtgttggcaaggatgaagaacaactggaactcgcatagactgctagtgggaagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactga

SEQ ID NO: 14712 - DNA, 927 bp, Artificial Sequence
  Synthetic polypeptide
attttggccatatataaaaattctaaatcggtcagagacctaaatgtaaaacctagaactataaaaattttagaacaaaacataggagagaatctttgtgatcttggattaggcaaagatttcttaaatatgataccaaaaaaagaacaatccattaacaaattgataaattgggcttcatcaaaattaaaaactgctcttcccaagacaatattaggagacagaaaagacaaacaagagactgggaaaaaaaatctttgtaaagcatatgtttgataaaagatttgcatccaaaatatataaagtgttctaagctcaataatgaaacaactcaacattaaatgggcaaaagatctgaacggacacttcaccaaggaaaatacactcgctgcaaatacgcacatgaaaagatgcttaacatcattaacgattagagaatgcataataaagccacaatgagctaccactacacagaaccggaacatctacagttaaaatctctggactttcaagtgttggcaaggatgaagaacaactggaactcgcatagactgctagtgggaagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagatccttgttggatatccagaaagaagtctttagcatcaaaggatcaagaagtccttccacttcgagaggcaatggcttcgatagtgaagttctgagaaaaagtactgctctggcactgggtggccttcgttttccgaggctcatggtacgtctggctctgatgaaagccacacagggatcctga

SEQ ID NO: 14713 - DNA, 618 bp, Artificial Sequence
  Synthetic polypeptide
gctccttcagattcagagcccagtaccttggactcccagtcttcgaccaccttgttcctctcctcggaggagccaggcccctccaccgccgccctgccatctccctcctcctcttcctgcgagcctcaggccttttccccaggtccgccagcgctgcctccgctgttgcctccgctccccgcagcctcggcgcccccaggccccggcgcctcccggcgcacaggccgctactcagtcgtcgcctcctccccggaggccgccccgcgtctggtcgactggctccccggttgcccttcgaccatctctcccagcacacgcggggatgacaaggagcggccgccgcccgtcctggcaccggccgagggcccggaaaggagccgcgccccgcgccccagcactgcgggcagggaggagggcaccgtggacgcgggtacatccccgccgccccgagcccggcccgccgctgcggcgagcttggaggcccacgtcggggacatcctggtggagctgcggaccatgaacggccacctggacagcatagcgcgggccctcaccaaactggcttcgtccctggggccccagcctgagcccctgccagatgtttcggatgccaactaa

SEQ ID NO: 14714 - DNA, 2643 bp, Artificial Sequence
  Synthetic polypeptide
tatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 14715 - DNA, 1734 bp, Artificial Sequence
  Synthetic polypeptide
tatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 14716 - DNA, 2228 bp, Artificial Sequence
  Synthetic polypeptide
ggccgggcatggtggctcatgcctataatgctagcactttgggaggccgaggcaggtggatcacctgaggtcaggagttcaagaccagcctggccaacatggcgaaaccccatctctactaaaaatacaaaattacccagacatggtggcacatgcctgtaatcccggctactcaggagaaggaaacaagcctgagaaaagaaataaataacctccgagcccggctacaggagccttcagcccaggcaaattgctgcgacagtgaaaagaatggtgacattggtcaacagatcaagacattggaccagaaaatcgagagagttgctgaagccaccagaatgctgaatggaagactggacaatgagtttgaccgccttatagttccagagccagatgtggattttgatgcaaaatggaatgaactcgatgcaaggatcaatgtgacggagaagaacgctgaagaacattgcttttacattgaggaaacccttcggggcgccattaatggagaggtgggtgacttgaagcagcttgttgatcagaaaatacagtctctggaagaccgtctggggagcgttctcctacagatgaccaataacactggtgcagagctcagtcccccaggggcagcagccctgccaggagtgtcagggtcaggagatgaacgggtcatgatggaattaaaccacctgaaggacaaagttcaagttgttgaagacatttgcctgctgaacatccagggaaagcctcatgggatggaaggtgccttgccaaacagggaagaccgcgcagtacgcgacagcctgcaccttttgaaatctctcaacgacacgatgcacaggaagtttcaagaaaccgaacaaaccatccagaaacttcaacaggattttagttttctttattctcaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctcatatggagaaaacttgcagcaagctggactctatctcaggaaatcttcagaggatcaaggaggggctcaacaagcatgtcagcagcctgtggaactgtgtcaggcagatgaacggaacgctcaggtcgcattccagagacatttctggcctgaagaattcagtccagcagttctacagccacgtcttccagatttctactgatttgcaagatctggtcaaatttcagccatcagcaaaggcgccctcgcccccgccgcccgcagaggccccgaaggagccgctgcagcccgagcccgccccgccgaggcccagcggccccgcaaccgcagaggaccctgggcgacggcccgtcctgccccagcggccccccgaggagaggccgccccagccgccaggctccaccggggtcatcgcggagacgggccaggccgggccccccgcaggcgcaggcgtgtctgggcggggtctgccgcggggcgtggacggccagaccgggagcggcaccgtccccggcgcagaaggcttcgcgggcgcaccaggatacccgaagtcacctcctgtagcttccccaggagctccggtgccttctctggtgtctttttctgcggggctcacccagaagcctttccccagtgatgggggcgttgtcctctttaacaaagtgctggtgaacgacggggatgtttacaaccccagcaccggggtcttcacggctccttatgatgggcgctacctgatcacggccaccctcacccccgagagagacgcctacgtggaagcagtgctgtcggtctccaacgccagcgtggcccagctgcataccgctgggtacaggagagagttcctggaataccaccgccctccaggagctttgcatacctgcgggggcccgggggcattccacctcatcgtgcacctgaaggcgggagatgcagtcaacgtcgtggtgactgggggcaagctggctcacacagactttgatgaaatgtactccacatttagtggggttttcttatatcctttcctttcccacctctaa

SEQ ID NO: 14717 - DNA, 1515 bp, Artificial Sequence
  Synthetic polypeptide
tgcaatggactgaatgtttgtgtcccctccaaattcctatgttgaaatcctaatgcccaaagtgatgggactaggaggtggggcctctgggaggcgattaggtcatgggggtggagcccacgtgggtgggataagtgcccttataaaagggaccccagcggctccctcactctcttgctgccatgggagtataccgtgaggagtggggcggctgtgtagacacctgatctgccggtgccttggtcttggacttccagcctccagaacttgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtggcgtggaggccccgatgatgatccgcctggtgaatggctcaggtccgcacgagggccgcgtggaagtgtaccacgaccggcgttggggcaccgtgtgtgacgacggctgggacaagaaggacggagacgtggtgtgccgcatgctcggcttccgcggtgtggaggaggtgtaccgcacagctcgattcgggcaaggcactgggaggatctggatggatgacgttgcctgcaagggcacagaggaaaccatcttccgctgcagcttctccaaatggggggtgacaaactgtggacatgccgaagatgccagcgtgacatgcaacagacactga

SEQ ID NO: 14718 - DNA, 1230 bp, Artificial Sequence
  Synthetic polypeptide
tgcaatggactgaatgtttgtgtcccctccaaattcctatgttgaaatcctaatgcccaaagtgatgggactaggaggtggggcctctgggaggcgattaggtcatgggggtggagcccacgtgggtgggataagtgcccttataaaagggaccccagcggctccctcactctcttgctgccatgggagtataccgtgaggagtggggcggctgtgtagacacctgatctgccggtgccttggtcttggacttccagcctccagaacttgtccaggccgcgcagctcccctgacgacctgaaggccctgactcgcaatgtgaaccggctgaatgagagcttccgggacttgcagctgcggctgctgcaggctccgctgcaagcggacctgacggagcaggtgtggaaggtgcaggacgcgctgcagaaccagtcagactcgttgctggcgctggcgggcgcagtgcagcggctggagggcgcgctgtgggggctgcaggcgcaggcggtgcagaccgagcaggcggtggccctgctgcgggaccgcacgggccagcagagcgacacggcgcagctggagctctaccagctgcaggtggagagcaacagtagccagctgctgctgaggcgccacgcgggcctgctggacgggctggcgcgcagggtgggcatcctgggcgaggagctggccgacgtgggcggcgtgctgcgcggcctcaaccacagcctgtcctacgacgtggccctccaccgcacgcggctgcaggacctgcgggtgctggtgagcaacgccagcgaggacacgcgccgcctgcgcctggcgcacgtaggcatggagctgcagctgaagcaggagctggccatgctcaacgcggtcaccgaggacctgcgcctcaaggactgggagcactccatcgcactgcggaacatctccctcgcgaaagggccaccgggacccaaaggtgatcagggggatgaaggaaaggaaggcaggcctggcatccctggattgcctggacttcgaggtctgcccggggagagaggtaccccaggattgcccgggcccaagggcgatgatgggaagctgggggccacaggaccaatgggcatgcgtgggttcaaaggtgaccgaggcccaaaaggagagaaaggagagaaaggagacagagctggggatgccagtaaggacattctgctggggccgtgggatatggtgttggcacagggctag

SEQ ID NO: 14719 - DNA, 2162 bp, Artificial Sequence
  Synthetic polypeptide
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaacaaagcctcccaatcaccggcctgcagaaagctctgtgtccaccggctcctcgggcagcagctttggcagtgggtatagcgtggacagtgaaggaagcagcagcactgcaggggagactaatctatttcctattccgaggatagggaagatgggacagaatggacaagagcctgtaaaacagccaggggtaggagtaggactagcagacactgaagctaaaactcaggtaatgggagaaatcaagattgcattgaagaaggaaatgaagacagatggtgaacaactaatagttgaaattctccaatgcagaaatattacatacaaatttaagtctcctgatcatctaccagatttatatgtgaaaatatatgtgatgaatatttctacccaaaaaaaggtgatcaagaaaaaaacaagagtatgcagacatgatcgagagccttcgtttaatgaaacttttcgattcagtctaagtcctgcaggacattctcttcagattttacttttctccaatggagggaagtttatgaaaaagaccttgattggtgaagcctgtatctggcttgacaaagtggatctcagaaaaagaatagtcaactggcacaaacttttggtcagtcctactcaaacgcattga

SEQ ID NO: 14720 - DNA, 1541 bp, Artificial Sequence
  Synthetic polypeptide
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataa

SEQ ID NO: 14721 - DNA, 401 bp, Artificial Sequence
  Synthetic polypeptide
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagcctgggattgttga

SEQ ID NO: 14722 - DNA, 443 bp, Artificial Sequence
  Synthetic polypeptide
tgatatggtttggctgtgtccctacccaaatgtcatcttgaattcccgtgtgttgtaggaggcacccggtgggaggtatatgagtcatgggggcgagtttttctcgtgctgttctcatgatagtgaataagtctcatgagatctgatggttttataaggaggagtttccctgcataagctctctctttgccttccgccatccactgagatgtgactttgccttctgccatgattgtgaggctttcccagccacgtggaactgtaatggattaggaattagaattgtgggtggtaaagaaatcccgggacatagtggagaaattggagcctatattgccaagattcttcctgggggaagtgcggaacagacggggaagcttatggaagatggcatggcagtgatcaaggttggagatcaagaaacacagcacacagatgagtga

SEQ ID NO: 14723 - DNA, 4487 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccagcacatccttgtgagctctactgccgacccatagatggccagttttctgagaaaatgctggatgctgtcattgatggtaccccttgctttgaaggcggcaacagcagaaatgtctgtattaatggcatatgtaagatggttggctgtgactatgagatcgattccaatgccaccgaggatcgctgcggtgtgtgcctgggagatggctcttcctgccagactgtgagaaagatgtttaagcagaaggaaggatctggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14724 - DNA, 4232 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaaggacagtgttaacatctcccagaagcaagagctatggcgggagaagtgggagaggcacaacttgccaagcagaagcctctctcggcgttccatcagcaaggagagatgggtggagacactggtggtggccgacacaaagatgattgaataccatgggagtgagaatgtggagtcctacatcctcaccatcatgaacatggtcactgggttgttccataacccaagcattggcaatgcaattcacattgttgtggttcggctcattctactcgaagaagaagagcaaggactgaaaatagttcaccatgcagaaaagacactgtctagcttctgcaagtggcagaagagtatcaatcccaagagtgacctcaatcctgttcatcacgacgtggctgtccttctcaccagaaaggacatctgtgctggtttcaatcgcccctgcgagaccctgggcctgtctcacctttcaggaatgtgtcagcctcaccgcagttgtaacatcaatgaagattcgggactccctctggctttcacaattgcccatgagctaggacacagcttcggcatccagcatgatgggaaagaaaatgactgtgagcctgtgggcagacatccgtacatcatgtcccgccagctccagtacgatcccactccgctgacatggtccaagtgcagcgaggagtacatcacccgcttcttggaccgaggctgggggttctgtcttgatgacatacctaaaaagaaaggcttgaagtccaaggtcattgcccccggagtgatctatgatgttcaccaccagtgccagctacaatatggacccaatgctaccttctgccaggaagtagaaaacgtctgccagacactgtggtgctccgtgaagggcttttgtcgctctaagctggacgctgctgcagatggaactcaatgtggtgagaagaagtggtgtatggcaggcaagtgcatcacagtggggaagaaaccagagagcattcctggaggctggggccgctggtcaccctggtcccactgttccaggacctgtggggctggagtccagagcgcagagaggctctgcaacaaccccgagccaaagtttggagggaaatattgcactggagaaagaaaacgctatcgcttgtgcaacgtccacccctgtcgctcagaggcaccaacatttcggcagatgcagtgcagtgaatttgacactgttccctacaagaatgaactctaccactggtttcccatttttaacccaggttatgttgacattgggctcattccaaaaggagcaagggacataagagtgatggaaattgagggagctggaaacttcctggccatcaggagtgaagatcctgaaaaatattacctgaatggagggtttattatccagtggaacgggaactataagctggcagggactgtctttcagtatgacaggaaaggagacctggaaaagctgatggccacaggtcccaccaatgagtctgtgtggatccagcttctattccaggtgactaaccctggcatcaagtatgagtacacaatccagaaagatggccttgacaatgatgttgagcagcagatgtacttctggcagtacggccactggacagagtgcagtgtgacctgcgggacaggtatccgccgccaaactgcccattgcataaagaagggccgcgggatggtgaaagctacattctgtgacccagaaacacagcccaatgggagacagaagaagtgccatgaaaaggcttgtccacccaggtggtgggcaggggagtgggaagcatgctcggcgacatgcgggccccacggggagaagaagcgaaccgtgctgtgcatccagaccatggtctctgacgagcaggctctcccgcccacagactgccagcacctgctgaagcccaagaccctcctttcctgcaacagagacatcctgtgcccctcggactggacagtgggcaactggagtgagtgttctgtttcctgtggtggtggagtgcggattcgcagtgtcacatgtgccaagaaccatgatgaaccttgcgatgtgacaaggaaacccaacagccgagctctgtgtggcctccagcaatgcccttctagccggagagttctgaaaccaaacaaaggcactatttccaatggaaaaaacccaccaacactaaagcccgtccctccacctacatccaggcccagaatgctgaccacacccacagggcctgagtctatgagcacaagcactccagcaatcagcagccctagtcctaccacagcctccaaagaaggagacctgggtgggaaacagtggcaagatagctcaacccaacctgagctgagctctcgctatctcatttccactggaagcacttcccagcccatcctcacttcccaatccttgagcattcagccaagtgaggaaaatgtttccagttcagatactggtcctacctcggagggaggccttgtagctacaacaacaagtggttctggcttgtcatcttcccgcaaccctatcacttggcctgtgactccattttacaataccttgaccaaaggtccagaaatggagattcacagtggctcaggggaagaaagagaacagcctgaggacaaagatgaaagcaatcctgtaatatggaccaagatcagagtacctggaaatgacgctccagtggaaagtacagaaatgccacttgcacctccactaacaccagatctcagcagggagtcctggtggccacccttcagcacagtaatggaaggactgctccccagccaaaggcccactacttccgaaactgggacacccagagttgaggggatggttactgaaaagccagccaacactctgctccctctgggaggagaccaccagccagaaccctcaggaaagacggcaaaccgtaaccacctgaaacttccaaacaacatgaaccaaacaaaaagttctgaaccagtcctgactgaggaggatgcaacaagtctgattactgagggctttttgctaaatgcctccaattacaagcagctcacaaacggccacggctctgcacactggatcgtcggaaactggagcgagtgctccaccacatgtggcctgggggcctactggagaagggtggagtgcagcacccagatggattctgactgtgcggccatccagagacctgaccctgcaaaaagatgccacctccgtccctgtgctggctggaaagtgggaaactggagcaagtgctccagaaactgcagtgggggcttcaagatacgcgagattcagtgcgtggacagccgggaccaccggaacctgaggccatttcactgccagttcctggccggcattcctcccccattgagcatgagctgtaacccggagccctgtgaggcgtggcaggtggagccttggagccagtgctccaggtcctgtggaggtggagttcaggagagaggagtgttctgtccaggaggcctctgtgattggacaaaaagacccacatccaccatgtcttgcaatgagcacctgtgctgtcactgggccactgggaactgggacctgtgttccacttcctgtggaggtggctttcagaagaggactgtccaatgtgtgccctcagagggcaataaaactgaagaccaagaccaatgtctatgtgatcacaaacccagacctccagaattcaaaaaatgcaaccagcaggcctgcaagaaaagtgccgatttactttgcactaaggacaaactgtcagccagtttctgccagacactgaaagccatgaagaaatgttctgtgcccaccgtgagggctgagtgctgcttctcgtgtccccagacacacatcacacacacccaaaggcaaagaaggcaacggttgctccaaaagtcaaaagaactctaa

SEQ ID NO: 14725 - DNA, 401 bp, Artificial Sequence
  Synthetic polypeptide
gaattttagctccagatcgactgcaagaacaaaccagcaatcccaagaggccccacagaccctctgaaggaagcggacttctcctgcaggaccggaagagacaccccaaatactgtgagtgccccagctgcggaagtgggaaagggagaccctcctctcccaagcacacacctccactggagaagctgaagactggatttttccaactaccacatggagactttttcattgaacccgtgaagaagcatccactggttgagggagggtaccacccgcacatcgtttacaggaggcagaaagttccagaaaccaaggagccaacctgtggattaaagggtattgtgactcacatgtcctcctgggttgaagaatctgttttgttcttttggttgttttattaa

SEQ ID NO: 14726 - DNA, 1556 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatga

SEQ ID NO: 14727 - DNA, 1088 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatga

SEQ ID NO: 14728 - DNA, 343 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattgtaagtttgctgaggcctccccagccatgctgaactactattgggaagaagttacctgcaactacagcaactccagactcatcaaaaacagaaat

SEQ ID NO: 14729 - DNA, 1520 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatga

SEQ ID NO: 14730 - DNA, 1052 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggtactgctgtgctctcacctccggggcgggtgtggggtggctatggaaggaacacaggaggggaactgactgccacagaccttgggaggaagggagaggagaagggggtgctcaagcttccctcttacatcctccagcaaaattatctgaagacaccggccacttctgtccttgctcctgcactcaggcaggagtgagtgtgaggttgaggggtgcggtgtgggtttcatga

SEQ ID NO: 14731 - DNA, 307 bp, Artificial Sequence
  Synthetic polypeptide
tgatatggtctggctctgtgtccccacccaaatctcatcttgaattgtaatccccatgtgttgggggagggaccttgtgggaggtgattagattatgggggcggtccccccatgctgttctcgtgatagtgagtgagttctcatgagatctgatggttttattaggggcttttccccacgtcactctttcttctccttcctgtggccatgtgaagaaggacatatttgcttccctttctgccatgattactattgggaagaagttacctgcaactacagcaactccagactcatcaaaaacagaaat

SEQ ID NO: 14732 - DNA, 2729 bp, Artificial Sequence
  Synthetic polypeptide
cctctttccggctgtgggactcaggcgagtcctttcagttgtctgagacgcagttcgtcatccggaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 14733 - DNA, 794 bp, Artificial Sequence
  Synthetic polypeptide
cctctttccggctgtgggactcaggcgagtcctttcagttgtctgagacgcagttcgtcatccggaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 14734 - DNA, 1688 bp, Artificial Sequence
  Synthetic polypeptide
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgagagatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctga

SEQ ID NO: 14735 - DNA, 737 bp, Artificial Sequence
  Synthetic polypeptide
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccagtgtttgatggactctttgagttttgtcagctctcaactggcggttcagttgctggagctgtgaagttaaaccgacaacagactgatatggctgttaattgggctggaggattacatcatgctaagaaatcagaagcatcaggattctgttacgttaatgatattgtgcttgccatccttgaattactaaagtatgttaatttatattga

SEQ ID NO: 14736 - DNA, 528 bp, Artificial Sequence
  Synthetic polypeptide
tgatatgctttggctgtgtccccactctgatttcatcttgaattgaagctcccacaattcccaggtgtcatgggagggacccggtgggaggtaactgaatcatgggagcaggtctttcctgtactgttttcatgatagtgaataagtctcacaagatctaacggttttataaaggggagttttcctgcacaagttctctcttgtctgccaccatgtaagatgtgcctttcaccttcggccatgattgtgaggcctctccagccaagtggaacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcagagatttaatgttggagaagattgtccag

SEQ ID NO: 14737 - DNA, 333 bp, Artificial Sequence; identical to SEQ ID NO: 6583
  Synthetic polypeptide

SEQ ID NO: 14738 - DNA, 929 bp, Artificial Sequence
  Synthetic polypeptide
tgtgatggttaattttatgtatcaatttgattgggctatgggatgcccagatagctggtaaagcattgctcctggatgtgtctgttggtgtgtttctggaagagattggcttttcaatgcagatcgctttttgccaatgcagaggggcagcatctagtccatcgagagcctgactagaacaaaagggtggaggaggggtgaattctctcttcttgagctggaacatgtgtcttcttctggcttcagacatcagagctcctggttcttgctccttgggactctgggacttacaccagtggcacccctggctccagccctttgaacctggactaagtcataccagcagctttcctggtcctccagcttgcaggtggcaaaacgtgggacttgctggcctttataatcatctgtttcttcttaccatttccatcttcctggggctgggccagcccaggagccccaaaagcaagaggaaggggcaagggcggcctgggcccctggcccctggccctcaccaggtgccactggacctggtgtcacggatgaaaccgtatgcccgcatggaggagtatgagaggaacatcgaggagatggtggcccagctgaggaacagctcagagctggcccagagaaagtgtgaggtcaacttgcagctgtggatgtccaacaagaggagcctgtctccctggggctacagcatcaaccacgaccccagccgtatccccgtggacctgccggaggcacggtgcctgtgtctgggctgtgtgaaccccttcaccatgcaggaggaccgcagcatggtgagcgtgccggtgttcagccaggttcctgtgcgccgccgcctctgcccgccaccgccccgcacagggccttgccgccagcgcgcagtcatggagaccatcgctgtgggctgcacctgcatcttctga

SEQ ID NO: 14739 - DNA, 223 bp, Artificial Sequence; identical to SEQ ID NO: 10070
  Synthetic polypeptide

SEQ ID NO: 14740 - DNA, 999 bp, Artificial Sequence
  Synthetic polypeptide
cctgaccttcccgggcctcagtttccccactcataagatgagggctagggctccatctggaaggcggtgaggattagtggcttcacaggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataa

SEQ ID NO: 14741 - DNA, 966 bp, Artificial Sequence
  Synthetic polypeptide
cctgaccttcccgggcctcagtttccccactcataagatgagggctagggctccatctggaaggcggtgaggattagtggcttcacaggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataa

SEQ ID NO: 14742 - DNA, 753 bp, Artificial Sequence; identical to SEQ ID NO: 7008
  Synthetic polypeptide

SEQ ID NO: 14743 - DNA, 1482 bp, Artificial Sequence
  Synthetic polypeptide
tgatatggtttggctgtgtccccatccaaatctcatcttgaattttaagccccataatccccatgtgtcatgggagggacccagtgtgaggcaatcggatcatgagggtggtttcccccatgctggtctcatgatagtgactgagttctcaggagatctgatggttttacaagcatctggcatttcccctgctggcactcattctctttcctgctgccctgtgaagaggtgccttttaccctgatcataagtttcctgaggcttccccagccatttggaactgagatcagtgcggttaattcttcaactatccaagcctcatattttggaacagacaagatcacccgtatcaacatagctggatggaaaacagatggcaaatggcagagagacatgtgcaatgtgttgctacagctggaagatataaattgcattaatttagattggatcaacggttcacgggaatacatccatgctgtaaacaatctccgtgttgttggtgctgaggtggcttattttattgatgttctcatgaaaaaatttgaatattccccttctaaagtgcacttgattggccacagcttgggagcacacctggctggggaagctgggtcaaggataccaggccttggaagaataactgggttggacccagctgggccatttttccacaacactccaaaggaagtcaggctagacccctcggatgccaactttgttgacgttattcatacaaatgcagctcgcatcctctttgagcttggtgttggaaccattgatgcttgtggtcatcttgacttttacccaaatggagggaagcacatgccaggatgtgaagacttaattacacctttactgaaatttaacttcaatgcttacaaaaaagaaatggcttccttctttgactgtaaccatgcccgaagttatcaattttatgctgaaagcattcttaatcctgatgcatttattgcttatccttgtagatcctacacatcttttaaagcaggaaattgcttcttttgttccaaagaaggttgcccaacaatgggtcattttgctgatagatttcacttcaaaaatatgaagactaatggatcacattattttttaaacacagggtccctttccccatttgcccgttggaggcacaaattgtctgttaaactcagtggaagcgaagtcactcaaggaactgtctttcttcgtgtaggcggggcagttaggaaaactggggagtttgccattgtcagtggaaaacttgagccaggcatgacttacacaaaattaatcgatgcagatgttaacgttggaaacattacaagtgttcagttcatctggaaaaaacatttgtttgaagattctcagaataagttgggagcagaaatggtgataaatacatctgggaaatatggatataaatctaccttctgtagccaagacattatgggacctaatattctccagaacctgaaaccatgctaa

SEQ ID NO: 14744 - DNA, 1898 bp, Artificial Sequence
  Synthetic polypeptide
tgatagggtttggctatgtcccacccaaatcttatcttgaattcccacgtgttgtgggagggacctggtgggaggcaactgaatcatggaagcaggtctttcccgtgctgttctcttgatagtaagtgtcacgggatctgatgattgtaagggggagattccctgcacaagctcactttgcctgctgccatccatgtaagatgtgacttgctgctccttgccttctgccatgattgtgaagcctccccacccatgtggaactgtatgtcattgatggtgccactgctctttggtgtgcagctggagcaggacattttgaagttgttaaacttctagtcagccatggagccaacgtgaaccataccacagtaactaattcaacccccctgcgggcagcatgctttgatggcagactggacattgtgaaatacttggttgaaaataatgccaacatcagcattgccaacaaatatgacaacacctgcctaatgattgcggcatataagggacacactgatgtggtcagataccttttagaacaacgtgctgatcccaatgccaaagcacattgtggagccacagcattgcactttgcagctgaagctgggcacatagatattgtgaaagagctgataaaatggcgtgctgctatagtagtgaatggccatgggatgacgccattgaaagtagctgccgaaagctgtaaagctgatgtcgtagaactgttactctctcatgctgattgcgaccgaagaagtcggattgaagctttggaactcttgggtgcctcctttgcaaatgaccgtgagaactatgacatcataaagacataccactatctatatttagccatgttagagaggttccaagatggtgataacattctcgaaaaagaggttcttccaccaatccatgcttatgggaatagaactgaatgtagaaatcctcaggaactggagtccattcggcaagacagagatgctcttcatatggaaggccttatagttcgggaacggattttaggtgctgacaatattgatgtttctcatcccatcatttacagaggagctgtttatgcggataatatggaatttgagcagtgtatcaagttgtggcttcatgccctgcacctcagacaaaaaggtaacaggaacacccacaaggatcttcttcgatttgctcaagttttctcacaaatgatacatttgaatgaaactgtgaaggccccagacatagaatgtgttttgagatgcagtgttttggaaatagaacaaagtatgaacagagtgaaaaatatttcagatgctgatgtccacaatgctatggacaattatgaatgtaatctctatacctttctgtatttagtgtgcatctctaccaaaacacagtgcagcgaagaagatcagtgcaaaattaacaagcagatctacaacctgattcaccttgatcccagaactcgtgaaggtttcaccttgctgcatctggctgtcaattccaatactccagttgatgatttccacaccaatgacgtctgcagctttccaaatgcacttgtcacaaagctcctgctggactgtggtgctgaggtgaatgccgtggacaatgagggaaacagtgcccttcatattatcgttcagtacaacaggcccatcagtgattttttgaccttgcactccatcatcattagcctagttgaagccggagctcacactgacatgacgaataaacagaataagactccgctagacaaaagtacaactggggtatctgaaatactgcttaaaactcaaatgaagatgagtctcaagtgcctggctgcccgagcagttcgggctaatgacattaactaccaagaccagatccccagaactcttgaagagtttgttggatttcattaa

SEQ ID NO: 14745 - DNA, 1739 bp, Artificial Sequence
  Synthetic polypeptide
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14746 - DNA, 1694 bp, Artificial Sequence
  Synthetic polypeptide
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctgggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14747 - DNA, 1616 bp, Artificial Sequence
  Synthetic polypeptide
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatgggagagatggactcatggaaacctggatcggtccttttagatgaaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14748 - DNA, 1628 bp, Artificial Sequence
  Synthetic polypeptide
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggacttgttccaaaagaagaattgagcacacagtctttggagccagtatccctgggagatccaaactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14749 - DNA, 1631 bp, Artificial Sequence
  Synthetic polypeptide
ggccgagcacagtggcttgcacctgtcatcccagagctttgggaggctgagatggaagaattgtttgaggccaggtgttcaagatcagcctaggcaacacaggaagatgctttctctacaaaaaaaaaattttaaattaggcaggtgagaccacaaaagcctatcagaggccacctattccagggacaactgcacagccggtcactctgatgcagcttctggctgtcactgtagctgtggccacccccaccaccttgccaaggccatccccttctgctgcttctaccaccagcatccccagaccacaatcagtgggccacaggagccaggagatggatctctggtccactgccacctacacaagcagccaaaacaggcccagagctgatccaggtatccaaaggcaagatccttcaggagctgccttccagaaacctgttggagcggatgtcagcctggactgcaaaattgacttgtcgtttttaattgatgggagcaccagcattggcaaacggcgattccgaatccagaagcagctcctggctgatgttgcccaagctcttgacattggccctgccggtccactgatgggtgttgtccagtatggagacaaccctgctactcactttaacctcaagacacacacgaattctcgagatctgaagacagccatagagaaaattactcagagaggaggactttctaatgtaggtcgggccatctcctttgtgaccaagaacttcttttccaaagccaatggaaacagaagcggggctcccaatgtggtggtggtgatggtggatggctggcccacggacaaagtggaggaggcttcaagacttgcgagagagtcaggaatcaacattttcttcatcaccattgaaggtgctgctgaaaatgagaagcagtatgtggtggagcccaactttgcaaacaaggccgtgtgcagaacaaacggcttctactcgctccacgtgcagagctggtttggcctccacaagaccctgcagcctctggtgaagcgggtctgcgacactgaccgcctggcctgcagcaagacctgcttgaactcggctgacattggcttcgtcatcgacggctccagcagtgtggggacgggcaacttccgcaccgtcctccagtttgtgaccaacctcaccaaagagtttgagatttccgacacggacacgcgcatcggggccgtgcagtacacctacgaacagcggctggagtttgggttcgacaagtacagcagcaagcctgacatcctcaacgccatcaagagggtgggctactggagtggtggcaccagcacgggggctgccatcaacttcgccctggagcagctcttcaagaagtccaagcccaacaagaggaagttaatgatcctcatcaccgacgggaggtcctacgacgacgtccggatcccagccatggctgcccatctgaagggagtgatcacctatgcgataggcgttgcctgggctgcccaagaggagctagaagtcattgccactcaccccgccagagaccactccttctttgtggacgagtttgacaacctccatcagtatgtccccaggatcatccagaacatttgtacagagttcaactcacagcctcggaactga

SEQ ID NO: 14750 - DNA, 834 bp, Artificial Sequence; identical to SEQ ID NO: 7252
  Synthetic polypeptide

SEQ ID NO: 14751 - DNA, 1691 bp, Artificial Sequence; identical to SEQ ID NO: 7480
  Synthetic polypeptide

SEQ ID NO: 14752 - DNA, 1727 bp, Artificial Sequence; identical to SEQ ID NO: 7481
  Synthetic polypeptide

SEQ ID NO: 14753 - DNA, 629 bp, Artificial Sequence; identical to SEQ ID NO: 7482
  Synthetic polypeptide

SEQ ID NO: 14754 - DNA, 1553 bp, Artificial Sequence; identical to SEQ ID NO: 7483
  Synthetic polypeptide

SEQ ID NO: 14755 - DNA, 1461 bp, Artificial Sequence
  Synthetic polypeptide
atgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctag

SEQ ID NO: 14756 - DNA, 1196 bp, Artificial Sequence; identical to SEQ ID NO: 13863
  Synthetic polypeptide

SEQ ID NO: 14757 - DNA, 1136 bp, Artificial Sequence; identical to SEQ ID NO: 13864
  Synthetic polypeptide

SEQ ID NO: 14758 - DNA, 1118 bp, Artificial Sequence; identical to SEQ ID NO: 13865
  Synthetic polypeptide

SEQ ID NO: 14759 - DNA, 1193 bp, Artificial Sequence; identical to SEQ ID NO: 13866
  Synthetic polypeptide

SEQ ID NO: 14760 - DNA, 1155 bp, Artificial Sequence
  Synthetic polypeptide
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactag

SEQ ID NO: 14761 - DNA, 957 bp, Artificial Sequence
  Synthetic polypeptide
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactag

SEQ ID NO: 14762 - DNA, 1098 bp, Artificial Sequence
  Synthetic polypeptide
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgcggggccaccagatcctgctgcctccaagctggggcctgagtag

SEQ ID NO: 14763 - DNA, 1093 bp, Artificial Sequence
  Synthetic polypeptide
tgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaacttggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagcacaggtacctgctgcatgccatgcctgagggcatcgaccagaacgaaccagacacgagtccctgccctctggaagctcacgttccagcagaggagaggacatggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaacc

SEQ ID NO: 14764 - DNA, 859 bp, Artificial Sequence; identical to SEQ ID NO: 6990
  Synthetic polypeptide

SEQ ID NO: 14765 - DNA, 657 bp, Artificial Sequence; identical to SEQ ID NO: 6991
  Synthetic polypeptide

SEQ ID NO: 14766 - DNA, 587 bp, Artificial Sequence; identical to SEQ ID NO: 6992
  Synthetic polypeptide

SEQ ID NO: 14767 - DNA, 568 bp, Artificial Sequence; identical to SEQ ID NO: 6993
  Synthetic polypeptide

SEQ ID NO: 14768 - DNA, 494 bp, Artificial Sequence; identical to SEQ ID NO: 6994
  Synthetic polypeptide

SEQ ID NO: 14769 - DNA, 368 bp, Artificial Sequence; identical to SEQ ID NO: 6995
  Synthetic polypeptide

SEQ ID NO: 14770 - DNA, 340 bp, Artificial Sequence; identical to SEQ ID NO: 8550
  Synthetic polypeptide

SEQ ID NO: 14771 - DNA, 1008 bp, Artificial Sequence
  Synthetic polypeptide
tgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggggtcgcagggagacttcccaagaaggacaacccgaggcgaggcttgtggctggccaactgccagcggctggaccccagcggccagggcctgtgggacccggcatccgagtacatctacttctgctccaaacactttgaggaggactgctttgagctggtgggaatcagtggatatcacaggctaaaggagggggcagtccccaccatatttgagtctttctccaagttgcgccggacaaccaagaccaaaggacacagttacccacctggccccgctgaagtcagccggctcagacgatgcaggaagcgctgctccgagggccgagggcccacaactccattttctccacctccacctgctgatgtcacctgctttcctgtggaagaggcctcagcacctgccactttgccggcctccccagctgggaggctggagcctggccttagcagccccttttcagacctactgggccccttgggtgcccaggcagatgaagcaggctgcagcgcccagccttcaccagagcggcagccctcccctctcgaaccacggccagtctccccctcagcgtatatgctgcgcctgcccccacccgccggagcctacatccagaatgaacacagctaccaggtgggcagcgccttactctggaagcggcgagccgaggcagcccttgatgcccttgacaaggcccagcgccagctgcaggcctgcaagcggcgggagcagcggctgcggttgagactgaccaagctgcagcaggagcgggcacgggagaagcgggcacaggcagatgcccgccagactctgaaggagcatgtgcaggactttgccatgcagctgagcagcagcatggcctga

SEQ ID NO: 14772 - DNA, 1331 bp, Artificial Sequence; identical to SEQ ID NO: 550
  Synthetic polypeptide

SEQ ID NO: 14773 - DNA, 1028 bp, Artificial Sequence; identical to SEQ ID NO: 551
  Synthetic polypeptide

SEQ ID NO: 14774 - DNA, 1295 bp, Artificial Sequence; identical to SEQ ID NO: 553
  Synthetic polypeptide

SEQ ID NO: 14775 - DNA, 1322 bp, Artificial Sequence; identical to SEQ ID NO: 554
  Synthetic polypeptide

SEQ ID NO: 14776 - DNA, 1013 bp, Artificial Sequence; identical to SEQ ID NO: 555
  Synthetic polypeptide

SEQ ID NO: 14777 - DNA, 2340 bp, Artificial Sequence
  Synthetic polypeptide
aaaaagttaacgcatgcatagcgctgagcacggtgcctgtcacaaactacgctctgaagaaactcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcctcaagtacagggtcatcaagggcaatatcgacaagttcacagagaagggcggactgtccttctccctgttgctgtgggccacgctgaacgccgccttcgtgctcgtgggctctgtgattgtggctttcatagagccggtggctgctggcagcggaatcccccagatcaagtgcttcctcaacggggtgaagatcccccacgtggtgcggctcaagacgttggtgatcaaagtgtccggtgtgatcctgtccgtggtcgggggcctggccgtgggaaaggaagggccgatgatccactcaggttcagtgattgccgccgggatctctcagggaaggtcaacgtcactgaaacgagatttcaagatcttcgagtacttccgcagagacacagagaagcgggacttcgtctccgcaggggctgcggccggagtgtcagcggcgtttggagcccccgtgggtggggtcctgttcagcttggaggagggtgcgtccttctggaaccagttcctgacctggaggatcttctttgcttccatgatctccacgttcaccctgaattttgttctgagcatttaccacgggaacatgtgggacctgtccagcccaggcctcatcaacttcggaaggtttgactcggagaaaatggcctacacgatccacgagatcccggtcttcatcgccatgggcgtggtgggcggtgtgcttggagcagtgttcaatgccttgaactactggctgaccatgtttcgaatcaggtacatccaccggccctgcctgcaggtgattgaggccgtgctggtggccgccgtcacggccacagttgccttcgtgctgatctactcgtcgcgggattgccagcccctgcaggggggctccatgtcctacccgctgcagctcttttgtgcagatggcgagtacaactccatggctgcggccttcttcaacaccccggagaagagcgtggtgagcctcttccacgacccgccaggctcctacaaccccctgaccctcggcctgttcacgctggtctacttcttcctggcctgctggacctacgggctcacggtgtctgccggggtcttcatcccgtccctgctcatcggggctgcctggggccggctctttgggatctccctgtcctacctcacgggggcggcgatctgggcggaccccggcaaatacgccctgatgggagctgctgcccagctgggcgggattgtgcggatgacactgagcctgaccgtcatcatgatggaggccaccagcaacgtgacctacggcttccccatcatgctggtgctcatgaccgccaagatcgtgggcgacgtcttcattgagggcctgtacgacatgcacattcagctgcagagtgtgcccttcctgcactgggaggccccggtcacctcacactcactcactgccagggaggtgatgagcacaccagtgacctgcctgaggcggcgtgagaaggtcggcgtcattgtggacgtgctgagcgacacggcgtccaatcacaacggcttccccgtggtggagcatgccgatgacacccagcctgcccggctccagggcctgatcctgcgctcccagctcatcgttctcctaaagcacaaggtgtttgtggagcggtccaacctgggcctggtacagcggcgcctgaggctgaaggacttccgagacgcctacccgcgcttcccacccatccagtccatccacgtgtcccaggacgagcgggagtgcaccatggacctctccgagttcatgaacccctccccctacacggtgccccaggaggcgtcgctcccacgggtgttcaagctgttccgggccctgggcctgcggcacctggtggtggtggacaaccgcaatcaggttgtcgggttggtgaccaggaaggacctcgccaggtaccgcctgggaaagagaggcttggaggagctctcgctggcccagacgtga

SEQ ID NO: 14778 - DNA, 383 bp, Artificial Sequence
  Synthetic polypeptide
aaaaagttaacgcatgcatagcgctgagcacggtgcctgtcacaaactacgctctgaagaaactcaccacgttctgcgcttttccgagtcggacatatgagcagcgtggagctggatgatgaacttttggacccggatatggaccctccacatcccttccccaaggagatcccacacaacgagaagctcctgtccctcaagtatgagagcttggactatgacaacagtgagaaccagctgttcctggaggaggagcggcggatcaatcacacggccttccggacggtggagatcaagcgctgggtcatctgcgccctcattgggatcctcacgggcctcgtggcctgcttcattgacatcgtggtggaaaacctggctggcct

SEQ ID NO: 14779 - DNA, 1516 bp, Artificial Sequence; identical to SEQ ID NO: 534
  Synthetic polypeptide

SEQ ID NO: 14780 - DNA, 591 bp, Artificial Sequence; identical to SEQ ID NO: 539
  Synthetic polypeptide

SEQ ID NO: 14781 - DNA, 482 bp, Artificial Sequence; identical to SEQ ID NO: 540
  Synthetic polypeptide

SEQ ID NO: 14782 - DNA, 444 bp, Artificial Sequence; identical to SEQ ID NO: 541
  Synthetic polypeptide

SEQ ID NO: 14783 - DNA, 334 bp, Artificial Sequence; identical to SEQ ID NO: 533
  Synthetic polypeptide

SEQ ID NO: 14784 - DNA, 38 bp, Artificial Sequence; identical to SEQ ID NO: 543
  Synthetic polypeptide

SEQ ID NO: 14785 - DNA, 245 bp, Artificial Sequence; identical to SEQ ID NO: 542
  Synthetic polypeptide

SEQ ID NO: 14786 - DNA, 382 bp, Artificial Sequence; identical to SEQ ID NO: 434
  Synthetic polypeptide

SEQ ID NO: 14787 - DNA, 282 bp, Artificial Sequence; identical to SEQ ID NO: 7621
  Synthetic polypeptide

SEQ ID NO: 14788 - DNA, 520 bp, Artificial Sequence; identical to SEQ ID NO: 6424
  Synthetic polypeptide

SEQ ID NO: 14789 - DNA, 355 bp, Artificial Sequence; identical to SEQ ID NO: 8039
  Synthetic polypeptide

SEQ ID NO: 14790 - DNA, 1532 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggaggtgggggtcagcccccgccaggccagccgccctgtccaggagggaggtgggggggtcagccccccacccggccagccgccccgtccaggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14791 - DNA, 1466 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggaggtgggggtcagcccccgccaggccagccgccctgtccaggagggaggtgggggggtcagccccccacccggccagccgccccgtccaggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14792 - DNA, 1325 bp, Artificial Sequence; identical to SEQ ID NO: 7686
  Synthetic polypeptide

SEQ ID NO: 14793 - DNA, 1691 bp, Artificial Sequence; identical to SEQ ID NO: 7687
  Synthetic polypeptide

SEQ ID NO: 14794 - DNA, 1541 bp, Artificial Sequence; identical to SEQ ID NO: 7688
  Synthetic polypeptide

SEQ ID NO: 14795 - DNA, 756 bp, Artificial Sequence; identical to SEQ ID NO: 8739
  Synthetic polypeptide

SEQ ID NO: 14796 - DNA, 473 bp, Artificial Sequence; identical to SEQ ID NO: 13837
  Synthetic polypeptide

SEQ ID NO: 14797 - DNA, 434 bp, Artificial Sequence; identical to SEQ ID NO: 8041
  Synthetic polypeptide

SEQ ID NO: 14798 - DNA, 191 bp, Artificial Sequence
  Synthetic polypeptide
gaatgaacactgaatcggaaatgtgaagcccaagtgagaagcgccaccttcaagtgaacgtcaccaacccagtacagtgcagcctgcacgggaagaagtgcaccgtctccgtggagacgcggctcaaccagccccagcccgacttcaccaagaatcgctcgggcttcatcctcagcgtgcccgggaactga

SEQ ID NO: 14799 - DNA, 871 bp, Artificial Sequence; identical to SEQ ID NO: 437
  Synthetic polypeptide

SEQ ID NO: 14800 - DNA, 421 bp, Artificial Sequence; identical to SEQ ID NO: 441
  Synthetic polypeptide

SEQ ID NO: 14801 - DNA, 638 bp, Artificial Sequence; identical to SEQ ID NO: 442
  Synthetic polypeptide

SEQ ID NO: 14802 - DNA, 337 bp, Artificial Sequence; identical to SEQ ID NO: 443
  Synthetic polypeptide

SEQ ID NO: 14803 - DNA, 462 bp, Artificial Sequence
  Synthetic polypeptide
cagatgtgacctgcctcaggaagaaatgtctgcctcatacacttaaatttaccctctatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataa

SEQ ID NO: 14804 - DNA, 1397 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaattcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14805 - DNA, 1331 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaattcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14806 - DNA, 120 bp, Artificial Sequence
  Synthetic polypeptide
ggctgggcatggtggctcacacctgtaatcccagcacttcgggaggccgaggttcccaatgctccacctgcttatgagaaactctctgcagaacagtcaccaccaccttattcaccttaa

SEQ ID NO: 14807 - DNA, 1746 bp, Artificial Sequence
  Synthetic polypeptide
tgatatagtttagctgtgtccccacccatatctcatcgtgaattccatgtcttgtgggagggactctgtgggaggaattgaatcatgggggcaggtcttttgtgtgctgttctcatgatagtgaataagtctcataagatctggtggttttataagggggagtttccctgcacaagctctctttctttgcctgccaccatccacataagatgtgacttgctcttccttgccttctgccatgattgtgaggcctccctagccatgtggaactgttattatatccgggaaaaatctaagcaagtcatcacattgctgatggatgaaccattgctgtgtaaagagagggaagtggcatgtcggactagacagcgtacctcccactctatattgttttctaaaagacaacttggttcaagtaactcactgacagcgtgcacttctgcccccacaccggatatttctgcttcagagaagaagtataagcttcctaagtttggaaggttacataataaaagaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaa

SEQ ID NO: 14808 - DNA, 1503 bp, Artificial Sequence
  Synthetic polypeptide
tgatatagtttagctgtgtccccacccatatctcatcgtgaattccatgtcttgtgggagggactctgtgggaggaattgaatcatgggggcaggtcttttgtgtgctgttctcatgatagtgaataagtctcataagatctggtggttttataagggggagtttccctgcacaagctctctttctttgcctgccaccatccacataagatgtgacttgctcttccttgccttctgccatgattgtgaggcctccctagccatgtggaactgaaatgtgtgcaaggcaggattgaaacaagagcattgccaagatgttcatttgcctacagaaactatgttgtcccaggaaacacttccactcaagattcatggttggaaatcaacagaggacctgatgacatttttggatgatgatccagagctgcctttactagcaacacctccttccattgtctctccaatcacttgcttgtcagaagcagaagaagtttgtaatctttcgggtgcagatgctgtgcctactctctcagaaaatagtccttctgggcagagagatgtgagtttggacaagagatcagatggtatctttacaaatactgtcacagaaaacctcttggaaacacctttagaaaagcaatcagctgcagaaggtcttaaaacattgacaattttaccagcatgttggtcaagtaaagaggagtttatcagccccgacttaagggtatcaaagtcagattctactttccataaccaggcctctgtagaaacactctgtctctctccctcattcaaaatatttgaccgagtgaaggagattgtaatcaacaaggcctaccagaaaccagcacaatccagcattcagatggatgataaaatcctcaagacaaccacacgggtttcaactgcttctgagggagcatcttccttttctcctttatccatgtcatctcctgatttagcctctccagagaagtcagctcatctcttatcaccaattctggccggaccttccttctggactctgtcccatcaacagttgtcttctacctcctttaaagatgaagataagacagccaagctgcatcactcctttgcttctaggggcccagtgtcttctgatgtagaggaaaatgatagcctcaatctactgggaattcttccaaataactctgattctgctaaaaagaatataagtcacatttctagtagtcactggggggagttttccacccaaaatgtagaccagttcatccctctgtcctgttctggttttcagtcaaccaaagacttcccccaggaacctgaagcaaagaattccattagtgttcttttaagggaggtaaaacgtgcgatcgctagattacatgaagatctgagcacagtgatccaagaacttaatgtcatcaataacatcttgatgagcatgagtctgaatagttcacaaataagccagtcttcccaggtcccccagtcttctgaggggagctcagatcagatctaa

SEQ ID NO: 14809 - DNA, 360 bp, Artificial Sequence
  Synthetic polypeptide
ggcagggtgcagtggctcacacctataataccagcactttgggaggctgaggtgactcgccgggccctattccctggagattctgagattgaccagctcttccggatctttcggactctggggaccccagatgaggtggtgtggccaggagttacttctatgcctgattacaagccaagtttccccaagtgggcccggcaagattttagtaaagttgtacctcccctggatgaagatggacggagcttgttatcgcaaatgctgcactacgaccctaacaagcggatttcggccaaggcagccctggctcaccctttcttccaggatgtgaccaagccagtaccccatcttcgactctga

SEQ ID NO: 14810 - DNA, 1708 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14811 - DNA, 1687 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14812 - DNA, 685 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14813 - DNA, 589 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 14814 - DNA, 733 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 14815 - DNA, 745 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 14816 - DNA, 154 bp, Artificial Sequence
  Synthetic polypeptide
actgtgtttccatttccgaagataaaaggattgttggagccaggtgtggggaggacagccagtgtatccccaggaaactgacgatgcctgcatcttccctgatggtggaccttgcccatctggctcttggtctcagaagagaagctttgtttat

SEQ ID NO: 14817 - DNA, 96 bp, Artificial Sequence
  Synthetic polypeptide
actgtgtttccatttccgaagataaaaggattgttggagccaggtgtggggaggacagccagtgtatccccaggaaactgacgatgcctgcatctt

SEQ ID NO: 14818 - DNA, 213 bp, Artificial Sequence; identical to SEQ ID NO: 7877
  Synthetic polypeptide

SEQ ID NO: 14819 - DNA, 2477 bp, Artificial Sequence
  Synthetic polypeptide
tgatatggtttggttctgcgtcctcacccagatctcatcttgtagctcccataatccccacatgttgtgggaaggacctggtgggagatgattgaattatggggatgggtctttcccatgctgttctcgtgatagtgaatgggtctcacaagatctgatggttttaaaaatgggaggtgccctgcacaagctctctttttgcctgctgccattcacataagatgtggcttgtccctctttgccatctgccatgattgtgaggcctccccagccatgtggaactgtatctttcagatgaaggcattgaagcttgcacaagctctccagacaaagtcaatgtaaatgacatcatcctgattgctctcaatacagatctgagaacaattggcaagaaattcctccccagtgacatcaatagtggaaaggtagaaaagctcgaaggtccatgtgttttgcaaattcaaaaaattcgcaatgttgctgcaccaaaggataatgaagaatctcaggctgcaccaaggatgctgcgattacagatgactgatggtcatataagttgcacagcagtagaatttagttatatgtcaaaaataagcctgaacacaccacctggaactaaagttaagctctcaggcattgttgacataaaaaatggattcctgctcttgaatgactctaacaccacagttcttggtggtgaagtggaacaccttattgagaaatgggagttacagagaagcttatcaaaacacaatagaagcaatattggaactgaaggtggaccaccgccttttgtgccttttggacagaagtgtgtatctcatgtccaagtggatagcagagaacttgatcgaagaaaaacattgcaagttacaatgcctgtcaaacctacaaatgataatgatgaatttgaaaagcaaaggacggctgctattgctgaagttgcaaagagcaaggaaaccaagacatttggaggaggtggtggtggtgctagaagtaatctcaatatgaatgctgctggtaaccgaaatagggaagttttacagaaagaaaagtcaaccaaatcagagggaaaacatgaaggtgtctatagagaactggttgatgagaaagctctgaagcacataacggaaatgggcttcagtaaggaagcatcgaggcaagctcttatggataatggcaacaacttagaagcagcactgaacgtacttcttacaagcaataaacagaaacctgttatgggtcctcctctgagaggtagaggaaaaggcagggggcgaataagatctgaagatgaagaggacctgggaaatgcaaggccatcagcaccaagcacattatttgatttcttggaatctaaaatgggaactttgaatgtggaagaacctaaatcacagccacagcagcttcatcagggacaatacagatcatcaaatactgagcaaaatggagtaaaagataataatcatctgagacatcctcctcgaaatgataccaggcagccaagaaatgaaaaaccgcctcgttttcaaagagactcccaaaattcaaagtcagttttagaaggcagtggattacctagaaatagaggttctgaaagaccaagtacttcttcagtatctgaagtatgggctgaagacagaatcaaatgtgatagaccgtattctagatatgacagaactaaagatacttcatatcctttaggttctcagcatagtgatggtgcttttaaaaaaagagataactctatgcaaagcagatcaggaaaaggtccctcctttgcagaggcaaaagaaaatccacttcctcaaggatctgtagattataataatcaaaaacgtggaaaaagagaaagccaaacatctattcctgattatttttatgacaggaaatcacaaacaataaataatgaagctttcagtggtataaaaattgaaaaacattttaatgtaaatactgattatcagaatccagttcgaagtaatagtttcattggtgttccaaatggagaagtagaaatgccactgaaaggaagacgaataggacctattaagccagcaggacctgtcacagctgtaccctgtgatgataaaatattttacaatagtgggcccaaacgaagatctgggccaattaagccagaaaaaatactagaatcatctattcctatggagtatgcaaaaatgtggaaacctggagatgaatgttttgcactttattgggaagacaacaagttttaccgggcagaagttgaagccctccattcttcgggtatgacagcagttgttaaattcattgactacggaaactatgaagaggtgctactgagcaatatcaagcccattcaaacagaggcatgggaggaagaaggcacctacgatcaaactctggagttccgtaggggaggtgatggccagccaagacgatccactcggccaacccaacagttttaccaaccaccccgggctcggaactaa

SEQ ID NO: 14820 - DNA, 216 bp, Artificial Sequence; identical to SEQ ID NO: 8799
  Synthetic polypeptide

SEQ ID NO: 14821 - DNA, 731 bp, Artificial Sequence
  Synthetic polypeptide
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctga

SEQ ID NO: 14822 - DNA, 289 bp, Artificial Sequence
  Synthetic polypeptide
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgaatcggggctgtctgtatggattggtgggcagct

SEQ ID NO: 14823 - DNA, 418 bp, Artificial Sequence
  Synthetic polypeptide
tttgctgctgctggacacccactcgctgaagatggtcctgctcgatctcccctccatcagctcgcaggtggtgaggaaggcacccgccagctacaccaagatcgttgtcaaaggcatgacccgggctgagatgatcctcaaggtagtgatggcccctcatgaaccgttggtggtgtttgttgacaactacatcaaacttctcacagactgcaacacagaaacctttcagaagatactggacatgaaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtag

SEQ ID NO: 14824 - DNA, 1691 bp, Artificial Sequence; identical to SEQ ID NO: 7480
  Synthetic polypeptide

SEQ ID NO: 14825 - DNA, 1727 bp, Artificial Sequence; identical to SEQ ID NO: 7481
  Synthetic polypeptide

SEQ ID NO: 14826 - DNA, 629 bp, Artificial Sequence; identical to SEQ ID NO: 7482
  Synthetic polypeptide

SEQ ID NO: 14827 - DNA, 1553 bp, Artificial Sequence; identical to SEQ ID NO: 7483
  Synthetic polypeptide

SEQ ID NO: 14828 - DNA, 96 bp, Artificial Sequence; identical to SEQ ID NO: 9766
  Synthetic polypeptide

SEQ ID NO: 14829 - DNA, 678 bp, Artificial Sequence; identical to SEQ ID NO: 8918
  Synthetic polypeptide

SEQ ID NO: 14830 - DNA, 726 bp, Artificial Sequence; identical to SEQ ID NO: 8919
  Synthetic polypeptide

SEQ ID NO: 14831 - DNA, 1816 bp, Artificial Sequence
  Synthetic polypeptide
tgaaactttggttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccgactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcgacttcaagcaccgcatcaccgtgcaggcctcacccggccttgaccggaggagaaacgtcttcgaggtcgggcctggggattcgcccacctttccccggttccgagccatccagttggagcctgcagagccaggccaggcatggggccgccagtccccccgacgtctggaggactcaagcaatggagagcggcgagcatgctgggcttggggtcccagttcccccaagcctggggaagcccagaatgggaggagaaggtcccgcatggacgaagccacatggtacctggattcagatgactcatcccccttaggatctccttccacacccccagcactcaatggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttga

SEQ ID NO: 14832 - DNA, 326 bp, Artificial Sequence; identical to SEQ ID NO: 6484
  Synthetic polypeptide

SEQ ID NO: 14833 - DNA, 146 bp, Artificial Sequence; identical to SEQ ID NO: 6485
  Synthetic polypeptide

SEQ ID NO: 14834 - DNA, 792 bp, Artificial Sequence; identical to SEQ ID NO: 6418
  Synthetic polypeptide

SEQ ID NO: 14835 - DNA, 369 bp, Artificial Sequence; identical to SEQ ID NO: 6419
  Synthetic polypeptide

SEQ ID NO: 14836 - DNA, 249 bp, Artificial Sequence; identical to SEQ ID NO: 6420
  Synthetic polypeptide

SEQ ID NO: 14837 - DNA, 369 bp, Artificial Sequence; identical to SEQ ID NO: 6421
  Synthetic polypeptide

SEQ ID NO: 14838 - DNA, 843 bp, Artificial Sequence; identical to SEQ ID NO: 6422
  Synthetic polypeptide

SEQ ID NO: 14839 - DNA, 322 bp, Artificial Sequence
  Synthetic polypeptide
ggcggcgtctagtgcctctgttaagatcgcgctctgagaaacaacgctggcattcaaatccagctttttggagaccacggcatatttcttcatgaaaccaaaacttggagagaaggaggtgtccccaaatgctttcttcagtatctggcatgaattcagctctgactttaaagacttctggaagaaagagaacaaacttcttctacaagagagagtaaaagaagccgaagaggtgtgtagacagaagaaaggaaaatcactttataaaataaaaccaagacatgactctggaattaaagcaaagataagcatgaaaacttga

SEQ ID NO: 14840 - DNA, 229 bp, Artificial Sequence
  Synthetic polypeptide
gtcctgttttccacttgaaactccaagcatacctgacatataacagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14841 - DNA, 560 bp, Artificial Sequence; identical to SEQ ID NO: 6321
  Synthetic polypeptide

SEQ ID NO: 14842 - DNA, 418 bp, Artificial Sequence; identical to SEQ ID NO: 11223
  Synthetic polypeptide

SEQ ID NO: 14843 - DNA, 386 bp, Artificial Sequence; identical to SEQ ID NO: 11224
  Synthetic polypeptide

SEQ ID NO: 14844 - DNA, 457 bp, Artificial Sequence; identical to SEQ ID NO: 11225
  Synthetic polypeptide

SEQ ID NO: 14845 - DNA, 496 bp, Artificial Sequence; identical to SEQ ID NO: 11226
  Synthetic polypeptide

SEQ ID NO: 14846 - DNA, 385 bp, Artificial Sequence; identical to SEQ ID NO: 11229
  Synthetic polypeptide

SEQ ID NO: 14847 - DNA, 385 bp, Artificial Sequence; identical to SEQ ID NO: 11229
  Synthetic polypeptide

SEQ ID NO: 14848 - DNA, 385 bp, Artificial Sequence; identical to SEQ ID NO: 11229
  Synthetic polypeptide

SEQ ID NO: 14849 - DNA, 418 bp, Artificial Sequence; identical to SEQ ID NO: 11223
  Synthetic polypeptide

SEQ ID NO: 14850 - DNA, 418 bp, Artificial Sequence; identical to SEQ ID NO: 11223
  Synthetic polypeptide

SEQ ID NO: 14851 - DNA, 418 bp, Artificial Sequence; identical to SEQ ID NO: 11223
  Synthetic polypeptide

SEQ ID NO: 14852 - DNA, 418 bp, Artificial Sequence; identical to SEQ ID NO: 11223
  Synthetic polypeptide

SEQ ID NO: 14853 - DNA, 418 bp, Artificial Sequence; identical to SEQ ID NO: 11223
  Synthetic polypeptide

SEQ ID NO: 14854 - DNA, 163 bp, Artificial Sequence; identical to SEQ ID NO: 480
  Synthetic polypeptide

SEQ ID NO: 14855 - DNA, 104 bp, Artificial Sequence; identical to SEQ ID NO: 481
  Synthetic polypeptide

SEQ ID NO: 14856 - DNA, 753 bp, Artificial Sequence; identical to SEQ ID NO: 7919
  Synthetic polypeptide

SEQ ID NO: 14857 - DNA, 873 bp, Artificial Sequence; identical to SEQ ID NO: 7920
  Synthetic polypeptide

SEQ ID NO: 14858 - DNA, 139 bp, Artificial Sequence; identical to SEQ ID NO: 8939
  Synthetic polypeptide

SEQ ID NO: 14859 - DNA, 368 bp, Artificial Sequence; identical to SEQ ID NO: 8940
  Synthetic polypeptide

SEQ ID NO: 14860 - DNA, 2192 bp, Artificial Sequence; identical to SEQ ID NO: 8941
  Synthetic polypeptide

SEQ ID NO: 14861 - DNA, 1328 bp, Artificial Sequence; identical to SEQ ID NO: 8942
  Synthetic polypeptide

SEQ ID NO: 14862 - DNA, 2117 bp, Artificial Sequence; identical to SEQ ID NO: 8943
  Synthetic polypeptide

SEQ ID NO: 14863 - DNA, 1265 bp, Artificial Sequence; identical to SEQ ID NO: 8944
  Synthetic polypeptide

SEQ ID NO: 14864 - DNA, 1331 bp, Artificial Sequence; identical to SEQ ID NO: 8945
  Synthetic polypeptide

SEQ ID NO: 14865 - DNA, 543 bp, Artificial Sequence; identical to SEQ ID NO: 6496
  Synthetic polypeptide

SEQ ID NO: 14866 - DNA, 378 bp, Artificial Sequence; identical to SEQ ID NO: 6497
  Synthetic polypeptide

SEQ ID NO: 14867 - DNA, 267 bp, Artificial Sequence; identical to SEQ ID NO: 6498
  Synthetic polypeptide

SEQ ID NO: 14868 - DNA, 416 bp, Artificial Sequence; identical to SEQ ID NO: 6499
  Synthetic polypeptide

SEQ ID NO: 14869 - DNA, 162 bp, Artificial Sequence; identical to SEQ ID NO: 6500
  Synthetic polypeptide

SEQ ID NO: 14870 - DNA, 763 bp, Artificial Sequence; identical to SEQ ID NO: 606
  Synthetic polypeptide

SEQ ID NO: 14871 - DNA, 1196 bp, Artificial Sequence
  Synthetic polypeptide
tgtggtggatacaggagatgcgctgcccagatctgcccccagggaaggaccctgctccagctgttggaggccggctggcccacagcctctagcagtcaagctcttttggctggaaagccgcttgcaggaaatcactccatggaggtgcagagataaggccccagacattttggcccagtatgggacaactttgaccgtctttttcagcttcaggactcccatggagttggaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaa

SEQ ID NO: 14872 - DNA, 807 bp, Artificial Sequence; identical to SEQ ID NO: 7401
  Synthetic polypeptide

SEQ ID NO: 14873 - DNA, 453 bp, Artificial Sequence; identical to SEQ ID NO: 7402
  Synthetic polypeptide

SEQ ID NO: 14874 - DNA, 976 bp, Artificial Sequence
  Synthetic polypeptide
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaagttcctggaggccacgctgcggtccctgacagcaggttggcacgtggagctggatcccttcacagcctcaacacccctggggccagtggactttggcaatgtggtggccacactggacccaagggctgcccgtcacctcacccttgcctgccattatgactcgaagctcttcccacccggatcgaccccctttgtaggggccacggattcggctgtgccctgtgccctgctgctggagctggcccaagcacttgacctggagctgagcagggccaaaaaacaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctag

SEQ ID NO: 14875 - DNA, 694 bp, Artificial Sequence
  Synthetic polypeptide
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggcagccccggtgaccctgcaactgctcttcttggatggtgaagaggcgctgaaggagtggggacccaaggactccctttacggttcccggcacctggcccagctcatggagtctatacctcacagccccggccccaccaggatccaggctattgagctctttatgcttcttgatctcctgggagcccccaatcccaccttctacagccacttccctcgcacggtccgctggttccatcggctgaggagcattgagaagcgtctgcaccgtttgaacctgctgcagtctcatccccaggaagtgatgtacttccaacccggggagccctttggctctgtggaagacgaccacatccccttcctccgcagaggggtacccgtgctccatctcatctccacgcccttccctgctgtctggcacacccctgcggacaccgaggtcaatctccacccacccacggtacacaacttgtgccgcattctcgctgtgttcctggctgaatacctggggctctag

SEQ ID NO: 14876 - DNA, 247 bp, Artificial Sequence
  Synthetic polypeptide
ctcactgggcctcgatttccccatcaagtttgaggtcccattgatcggaagcctccccgaagcccggctgcggagggtggtgggacaactggatccacagcgtctctggagcacttatctgcgccccctgctggttgtgcgaaccccgggcagcccgggaaatctccaagtcagaaaggggccacggattcggctgtgccctgtgccctgctgctggagctggcccaagcacttgacctggagctga

SEQ ID NO: 14877 - DNA, 947 bp, Artificial Sequence; identical to SEQ ID NO: 6434
  Synthetic polypeptide

SEQ ID NO: 14878 - DNA, 881 bp, Artificial Sequence; identical to SEQ ID NO: 6435
  Synthetic polypeptide

SEQ ID NO: 14879 - DNA, 797 bp, Artificial Sequence
  Synthetic polypeptide
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggc

SEQ ID NO: 14880 - DNA, 552 bp, Artificial Sequence
  Synthetic polypeptide
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttga

SEQ ID NO: 14881 - DNA, 819 bp, Artificial Sequence
  Synthetic polypeptide
ctcgctccctctcctttcagctctactccgacgtcactccttcccagacgaccttattatccacgcggtacttctcgccctacaataaaccctttgttttgtgcacctacaatctcaaatgcctattttgcttaagcattttcccctttgtttcctcgctggaacataagcttcctaaagaaaggaactttacataaaactatctggtttcattactgtgcttccagcgctgtaactgcctggccagcgaagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactga

SEQ ID NO: 14882 - DNA, 368 bp, Artificial Sequence; identical to SEQ ID NO: 6482
  Synthetic polypeptide

SEQ ID NO: 14883 - DNA, 356 bp, Artificial Sequence
  Synthetic polypeptide
tgatatggtttgtgtccccagccaaatctcatcttgaattgtagttcccataatccccacgtgtcatgggagggacccagtgggaggtaattgaatcatggggatgattactaacctcatggtgttctcgtgatagtgagttctcacaagatctgatggttttataaggagcttttcccccttttgctctgcacttcttgctgctgccatgtgaaggacatgtttgcttccccttctgccatgattcagtccctggaggaggattgtgtgtccattttacagctggagaagccgagatccagaaaggacccccaagttgtgggcagaataaatctacagcagcttttaactattaa

SEQ ID NO: 14884 - DNA, 333 bp, Artificial Sequence; identical to SEQ ID NO: 6583
  Synthetic polypeptide

SEQ ID NO: 14885 - DNA, 1883 bp, Artificial Sequence; identical to SEQ ID NO: 6345
  Synthetic polypeptide

SEQ ID NO: 14886 - DNA, 1045 bp, Artificial Sequence; identical to SEQ ID NO: 8898
  Synthetic polypeptide

SEQ ID NO: 14887 - DNA, 742 bp, Artificial Sequence; identical to SEQ ID NO: 6357
  Synthetic polypeptide

SEQ ID NO: 14888 - DNA, 590 bp, Artificial Sequence; identical to SEQ ID NO: 6358
  Synthetic polypeptide

SEQ ID NO: 14889 - DNA, 577 bp, Artificial Sequence; identical to SEQ ID NO: 6359
  Synthetic polypeptide

SEQ ID NO: 14890 - DNA, 430 bp, Artificial Sequence; identical to SEQ ID NO: 6360
  Synthetic polypeptide

SEQ ID NO: 14891 - DNA, 670 bp, Artificial Sequence; identical to SEQ ID NO: 6361
  Synthetic polypeptide

SEQ ID NO: 14892 - DNA, 1062 bp, Artificial Sequence
  Synthetic polypeptide
caggggtccccaatcccaagcctggtccgagacctgttaggaacagggcatcgcagcaggagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctga

SEQ ID NO: 14893 - DNA, 80 bp, Artificial Sequence
  Synthetic polypeptide
caggggtccccaatcccaagcctggtccgagacctgttaggaacagggcatcgcagcaggagggacaccacatcatttga

SEQ ID NO: 14894 - DNA, 3083 bp, Artificial Sequence
  Synthetic polypeptide
tgatatggtttggctccgtgtccccaaccaaatctcatgttgaattgtaatacccagtgttggaggtgggacctggtgggaggtgattggatcatgggggtggtttctgatggtttagcaccatcctgctcgtgctgtctcatgatagagttctcacaagatctggctgtttaaaagtgtgtagcacctccccctttgccctcttcctccttctctggacacataagacatgcctgcttccccttcaccttccaccatgattgtaagtttcctgaagcctccccagccatgcttcctatacagcctgcagaactgtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaaggcctccaaatgttccccctaagccccagaaacacaggaagtccaggccccgctcacagtataatactaagttgtttaatggggatttggaaacattcgtcaaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaa

SEQ ID NO: 14895 - DNA, 3014 bp, Artificial Sequence
  Synthetic polypeptide
tgatatggtttggctccgtgtccccaaccaaatctcatgttgaattgtaatacccagtgttggaggtgggacctggtgggaggtgattggatcatgggggtggtttctgatggtttagcaccatcctgctcgtgctgtctcatgatagagttctcacaagatctggctgtttaaaagtgtgtagcacctccccctttgccctcttcctccttctctggacacataagacatgcctgcttccccttcaccttccaccatgattgtaagtttcctgaagcctccccagccatgcttcctatacagcctgcagaactgtgatgaaaacataccatatgtatcatgcagagagcatcagtgcagagagcaagctgaaagaggccgaaaaacaagaggaaaagcaaattgggagatctggtgatccagtcttccatattcgactagaggagagacatcaacggcgaagctctgtaaagaaaattgaaaaaatgaaagaaaaaagacaagcaaaatattcagaaaataagctaaaatcaattaaggcacggaacgaatatctcctaacacttgaagccaccaatgcctcagttttcaagtactatattcatgatctttctgatttaattgattgctgtgatcttggctaccatgcaagtctgaacagagccctaagaacatatctgtctgcggagtacaaccttgaaacctccagacatgagggcttagacattattgagaatgcagttgataatttagagcccaggagcgataagcagagattcatggagatgtaccctgctgcgttctgtccaccaatgaagtttgagtttcagtctcacatgggtgatgaggtgtgccaggtcagtgcccagcagccagtccaggcagagctcatgctcaggtaccaacagttgcagtcccgccttgccacgctcaaaatcgagaatgaagaggttaagaaaacgactgaagccaccttgcagacgatacaagatatggtcaccatcgaggactatgatgtttctgaatgcttccagcacagtcgttccacagaatcagtgaagtccactgtctctgaaacctacctgagtaaacccagcatcgccaagagaagagccaaccagcaggaaactgaacagttctacttcatgaaactcagagaatatttggaaggcagtaatctcatcacaaaacttcaagccaaacatgacttgctgcagaggaccctgggagaaggtcatagagctgaatatatgactacaagccgaggacgaagaaactcgcacacaagacatcaggactcaggacaggttattcccctcattgtggaaagctgtattcggttcatcaatctctatggtcttcagcatcaggggattttcagagtgtctggttcccaggtggaagtcaatgatattaaaaattcatttgagagaggtgaaaatcctttggctgatgaccagagtaaccatgatattaactcagttgctggcgttctgaagctctatttccgtgggctggaaaaccccctctttcctaaggaaagatttaacgatctgatttcttgtatcagaatagataatctctatgagagggcgcttcacatccgcaaactcctcctgactttgcccaggtcggtccttatagtgatgaggtacctctttgccttcctcaatcatctatcacagtacagcgatgagaatatgatggacccttataacctggccatttgctttggcccaacattgatgcctgtcccagaaatacaggatcaagtgtcttgccaggcacatgtgaatgaaattatcaaaaccatcatcatccaccatgagactattttcccagatgctaaagagctggatggccctgtttatgagaaatgtatggctggagatgactattgcgacagcccatacagtgagcacggtacattggaggaagtggaccaagatgctggtacagagccccacacaagtgaagatgaatgtgagccaatagaagcaatagccaagtttgactatgttgggcggtctgccagagaactatccttcaagaagggtgcctccctgctgctgtatcaccgtgcatctgaggactggtgggaaggcaggcacaacgggattgacgggctggtgcctcaccagtatatagtggtgcaggatatggatgatacgttttcagacactctgagccaaaaagccgacagtgaggccagcagtgggccagtcacggaagacaagtcctcatccaaggacatgaactccccgacagaccgtcatcctgacggctatttagccaggcaacgaaaaagaggagagccaccccctccagtaaggcgtcctggcaggaccagtgatggccattgcccgctccaccctccacatgccctttctaactcctcagttgacctagggtccccaagccttgccagtcacccccggggcctgctgcagaaccgtggcctcaacaatgacagtcctgagcggaggcgcaggcctggccatggcagcctgaccaacatcagccggcacgactccctcaagaagatcgacagccctcccattagaaggtccacgtcatcagggcaatacacgggcttcaatgaccacaagccactggacccagagacaattgctcaggatattgaagaaacgatgaacacagctttgaatgaactccgagaactggagagacagagcacagcaaagcatgcccctgatgtggtgctggataccctggagcaagtgaaaaactctcccacccctgccacttccacggaatctctcagccctttgcacaacgttgccctcaggagctccgagcctcagattcgacgtagcacgagctcctccagtgacacaatgagtactttcaagcctatggtggcacccagaatgggcgtgcagctgaagcctccagcccttaggccaaaacctgctgttcttccaaaaacaaatcctaccataggacctgccccacctccccagggtccaacagacaagtcatgcacaatgtaa

SEQ ID NO: 14896 - DNA, 2169 bp, Artificial Sequence
  Synthetic polypeptide
tgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtagagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtcagtgagaccaagaacccaccaattccggacgcagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggaacagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctag

SEQ ID NO: 14897 - DNA, 1432 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacgtgagtggtagccgccgctga

SEQ ID NO: 14898 - DNA, 1618 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaaggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaa

SEQ ID NO: 14899 - DNA, 1708 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatgtaa

SEQ ID NO: 14900 - DNA, 1558 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccagagcccccagaactgcagcatcatgtaa

SEQ ID NO: 14901 - DNA, 1774 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaagacttattctgccaagctggacaatgccaggcagtctgctgagaggaacagcaacctggtgggggctgcccacgaggagctgcagcagtcgcgcatccgcatcgacagcctctctgcccagctcagccagctccagaagcagctggcagccaaggaggcgaagcttcgagacctggaggactcactggcccgtgagcgggacaccagccggcggctgctggcggaaaaggagcgggagatggccgagatgcgggcaaggatgcagcagcagctggacgagtaccaggagcttctggacatcaagctggccctggacatggagatccacgcctaccgcaagctcttggagggcgaggaggagaggctacgcctgtcccccagccctacctcgcagcgcagccgtggccgtgcttcctctcactcatcccagacacagggtgggggcagcgtcaccaaaaagcgcaaactggagtccactgagagccgcagcagcttctcacagcacgcacgcactagcgggcgcgtggccgtggaggaggtggatgaggagggcaagtttgtccggctgcgcaacaagtccaatgaggaccagtccatgggcaattggcagatcaagcgccagaatggagatgatcccttgctgacttaccggttcccaccaaagttcaccctgaaggctgggcaggtggtgacgatctgggctgcaggagctggggccacccacagcccccctaccgacctggtgtggaaggcacagaacacctggggctgcgggaacagcctgcgtacggctctcatcaactccactggggaagaagtggccatgcgcaagctggtgcgctcagtgactgtggttgaggacgacgaggatgaggatggagatgacctgctccatcaccaccacggctcccactgcagcagctcgggggaccccgctgagtacaacctgcgctcgcgcaccgtgctgtgcgggacctgcgggcagcctgccgacaaggcatctgccagcggctcaggagcccaggtgggcggacccatctcctctggctcttctgcctccagtgtcacggtcactcgcagctaccgcagtgtggggggcagtgggggtggcagcttcggggacaatctggtcacccgctcctacctcctgggcaactccagcccccgaacccagagcccccagaactgcagcatcatacaagagatgggaatgaggtgggaggtggaagaagggagaagaaaggtgagtttgagctgccttccctag

SEQ ID NO: 14902 - DNA, 508 bp, Artificial Sequence
  Synthetic polypeptide
ggctgggtgtggtggctcacgcctgtaatcccaggactttgggaggctgatgcaggaggatcacgtgagcaataccaagaaggagggtgacctgatagctgctcaggctcggctgaaggacctggaggctctgctgaactccaaggaggccgcactgagcactgctctcagtgagaagcgcacgctggagggcgagctgcatgatctgcggggccaggtggccaagcttgaggcagccctaggtgaggccaagaagcaacttcaggatgagatgctgcggcgggtggatgctgagaacaggctgcagaccatgaaggaggaactggacttccagaagaacatctacagtgaggagctgcgtgagaccaagcgccgtcatgagacccgactggtggagattgacaatgggaagcagcgtgagtttgagagccggctggcggatgcgctgcaggaactgcgggcccagcatgaggaccaggtggagcagtataagaaggagctggagaag

SEQ ID NO: 14903 - DNA, 80 bp, Artificial Sequence; identical to SEQ ID NO: 6364
  Synthetic polypeptide

SEQ ID NO: 14904 - DNA, 217 bp, Artificial Sequence; identical to SEQ ID NO: 6365
  Synthetic polypeptide

SEQ ID NO: 14905 - DNA, 1320 bp, Artificial Sequence; identical to SEQ ID NO: 8817
  Synthetic polypeptide

SEQ ID NO: 14906 - DNA, 420 bp, Artificial Sequence; identical to SEQ ID NO: 8818
  Synthetic polypeptide

SEQ ID NO: 14907 - DNA, 1101 bp, Artificial Sequence; identical to SEQ ID NO: 8142
  Synthetic polypeptide

SEQ ID NO: 14908 - DNA, 1896 bp, Artificial Sequence; identical to SEQ ID NO: 8143
  Synthetic polypeptide

SEQ ID NO: 14909 - DNA, 1662 bp, Artificial Sequence; identical to SEQ ID NO: 8144
  Synthetic polypeptide

SEQ ID NO: 14910 - DNA, 630 bp, Artificial Sequence
  Synthetic polypeptide
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctga

SEQ ID NO: 14911 - DNA, 360 bp, Artificial Sequence
  Synthetic polypeptide
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaagggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctga

SEQ ID NO: 14912 - DNA, 858 bp, Artificial Sequence
  Synthetic polypeptide
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctga

SEQ ID NO: 14913 - DNA, 768 bp, Artificial Sequence
  Synthetic polypeptide
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctga

SEQ ID NO: 14914 - DNA, 428 bp, Artificial Sequence
  Synthetic polypeptide
gcagtggttaacagtgcagtctctgccgtcgggtagaactcgactgaaatcctgactccttcctttaggagctggattacctttgagaacagccccagcccaggtgggaaggaggcagaaactcggcagcctgtggtgattctcttgggctggggtggctgcaaggacaagaaccttgccaagtacagtgccatctaccacaaaaggctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggc

SEQ ID NO: 14915 - DNA, 630 bp, Artificial Sequence; identical to SEQ ID NO: 9907
  Synthetic polypeptide

SEQ ID NO: 14916 - DNA, 711 bp, Artificial Sequence; identical to SEQ ID NO: 9908
  Synthetic polypeptide

SEQ ID NO: 14917 - DNA, 913 bp, Artificial Sequence; identical to SEQ ID NO: 13870
  Synthetic polypeptide

SEQ ID NO: 14918 - DNA, 169 bp, Artificial Sequence; identical to SEQ ID NO: 13871
  Synthetic polypeptide

SEQ ID NO: 14919 - DNA, 1469 bp, Artificial Sequence; identical to SEQ ID NO: 10631
  Synthetic polypeptide

SEQ ID NO: 14920 - DNA, 1067 bp, Artificial Sequence; identical to SEQ ID NO: 9936
  Synthetic polypeptide

SEQ ID NO: 14921 - DNA, 968 bp, Artificial Sequence; identical to SEQ ID NO: 9937
  Synthetic polypeptide

SEQ ID NO: 14922 - DNA, 459 bp, Artificial Sequence; identical to SEQ ID NO: 6625
  Synthetic polypeptide

SEQ ID NO: 14923 - DNA, 490 bp, Artificial Sequence
  Synthetic polypeptide
ctccttgtctttgctcatgctgtgcccttacctggaatgcctttttcccattccttgttattaataaaatcttccaaggccctacttaaatgtcctctctgaatgaagccttccttgattctccccccaccctccaaatgacttgctgccgcttctgttcatagagcgcttcgtttatatccccagagcactcattactctctgacttgtctgtccccctgttagattcctggagggaaccgaacatgcctaaatcacctgtttctgaccagcactgtaggtattcagtgttcgagagcggactgagaaattgcccatgggctccataaaaaatgtggtcagtgaacctatcgaaggacatgaagactaccacatgatggcgtttcagttgggccccacggaagcctcttactactgggtgtactgggttccaactcaatatgtggatgcaatcaaagacactgtgctggggaaatggcagtatttttga

SEQ ID NO: 14924 - DNA, 665 bp, Artificial Sequence; identical to SEQ ID NO: 6374
  Synthetic polypeptide

SEQ ID NO: 14925 - DNA, 518 bp, Artificial Sequence; identical to SEQ ID NO: 6375
  Synthetic polypeptide

SEQ ID NO: 14926 - DNA, 409 bp, Artificial Sequence
  Synthetic polypeptide
ggaaccttaatgaggtgagaccctccaacccagaggaaatacactgtgcagcaccaattggccaactttggatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 14927 - DNA, 1500 bp, Artificial Sequence; identical to SEQ ID NO: 9786
  Synthetic polypeptide

SEQ ID NO: 14928 - DNA, 168 bp, Artificial Sequence; identical to SEQ ID NO: 8710
  Synthetic polypeptide

SEQ ID NO: 14929 - DNA, 560 bp, Artificial Sequence; identical to SEQ ID NO: 6322
  Synthetic polypeptide

SEQ ID NO: 14930 - DNA, 621 bp, Artificial Sequence
  Synthetic polypeptide
ggctggctgcagtggctcacacttttgatgccaccactttgggaggctgagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 14931 - DNA, 768 bp, Artificial Sequence
  Synthetic polypeptide
ggctggctgcagtggctcacacttttgatgccaccactttgggaggctgagggcatcttcctccatctgagcaatcagcatgaatttggccggctcctggccacttccagatacgacacggagcacctgcaccccgacctctggcagatcttcgacaaccccgtcgactggaaggagcagtacatccacgagaactacagccgggccctggaaggggaaggaatcgtggagcagccatgcccggacgtgtactggttcccactgctgtcagaacaaatgtgtgatgagctggtggcagagatggagcactacggccagtggtcaggcggccggcatgaggattcaaggctggctggaggctacgagaatgtgcccaccgtggacatccacatgaagcaggtggggtacgaggaccagtggctgcagctgctgcggacgtatgtgggccccatgaccgagagcctgtttcccggttaccacaccaaggcgcgggcggtgatgaactttgtggttcgctaccggccagacgagcagccgtctctgcggccacaccacgactcatccaccttcaccctcaacgttgccctcaaccacaagggcctggactatgagggaggtggctgccgcttcctgcgctacgactgtgtgatctcctccccgaggaagggctgggcactcctgcaccccggccgcctcacccactaccacgaggggctgccaacgacctggggcacacgctacatcatggtgtcctttgtcgacccctga

SEQ ID NO: 14932 - DNA, 1220 bp, Artificial Sequence
  Synthetic polypeptide
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14933 - DNA, 1139 bp, Artificial Sequence
  Synthetic polypeptide
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagccttttatgtcaccgcgatacgcaggcggccccaggcccccgatcagaatgggaaaccagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14934 - DNA, 1160 bp, Artificial Sequence
  Synthetic polypeptide
gaacatgacagacatcctctgcccttcagcctgtgccccagaatgagagacccatgggacagactcaagctgtaccctgaagcagagctgcccagttgactgcagacctgttagctttatacgtctacgaatatttactgcacgtaggagcacagaaatctgcacagaccttcttatcggagattcgatgggaaaaaaacatcacgttgggagaaccgcctgggtttttgcactcgtggtggtgtgtattttgggacctttactgtgcagctcctgaaaggagagacacttgtgaacattcaagtgaagcaaaagcctttcatgattatagtgcagcagctgccccgagccccgtgcttggcaacattccccccaacgatgggatgccgggaggccccatcccgccaggtttctttcagggtcctccggggtcacagccctcgccgcacgcacagcctccacctcacaatcctagcagcatgatgggaccccacagtcagcctccgggaggagttcctgggacacagccattgctgcccaattctatggatcccacacgacaacaaggccaccccaacatgggaggatcaatgcagagaatgaaccctccccgaggcatggggcccatgggtcccggcccacagaattacggcagcggcatgagaccaccacccaactccctcggccccgccatgcccgggattaacatgggcccgggagctggcagaccctggcccaatcctaacagtgctaactcaattccatactcctcctcatcacctggtacctatgtgggaccccctggtggtggcggtcctccaggaacacccattatgcccagtcccgcagattcaacaaattccagtgacaacatctacacaatgattaatccagtgccgcctggaggcagccggtccaacttcccgatgggtcccggctcggacggtccgatgggcggcatgggtggcatggagccacaccacatgaatggatcattagggtcaggcgacatagacggacttccaaaaaattctcctaacaacataagtggcattagcaatcctccaggcacccctcgagatgacggcgagctaggagggaacttcctccactcctttcagaacgacaattattctccaagcatgacgatgagtgtgtga

SEQ ID NO: 14935 - DNA, 769 bp, Artificial Sequence; identical to SEQ ID NO: 6486
  Synthetic polypeptide

SEQ ID NO: 14936 - DNA, 575 bp, Artificial Sequence
  Synthetic polypeptide
ggccgggcgcagtggctcacacctgtaatcccagtactttgggaggccaaggggaggatcacctgaggtcaggagttcgagaccagcctgggcaatatggtgaaacccccgtctctacaaaaaattagccagatcccagctctcctgttggcttcgtgcttggggtagatcttcttcacatattccccctggaaggagcaacttttctgtgccctgctgacgtgactgacccgagaacctcacagagaatcctcgaggtgcttcctggcaggagagcagatgtgattctgagcgacatggcgcccaatgccacagggttccgggacctcgatcatgacaggctcatcagcctgtgcctgacccttctcagcgtgaccccagacatcctgcaacctggggggacattcctttgtaaaacctgggctggaagtcaaagccgtcggttacagaggagactgacagaggaattccagaatgtaaggatcatcaaacctgaagccagcaggaaagagtcatcagaagtgtacttcttggccacacagtaccacggaaggaagggcactgtgaagcagtga

SEQ ID NO: 14937 - DNA, 168 bp, Artificial Sequence
  Synthetic polypeptide
ggccgggcgcagtggctcacacctgtaatcccagtactttgggaggccaaggggaggatcacctgaggtcaggagttcgagaccagcctgggcaatatggtgaaacccccgtctctacaaaaaattagccagatcccagctctcctgttggcttcgtgcttggggtag

SEQ ID NO: 14938 - DNA, 839 bp, Artificial Sequence; identical to SEQ ID NO: 9123
  Synthetic polypeptide

SEQ ID NO: 14939 - DNA, 280 bp, Artificial Sequence
  Synthetic polypeptide
cagatgtgacctgcctcaggaagaaatgtctgcctcatacacttaaatttaccctcacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataa

SEQ ID NO: 14940 - DNA, 1304 bp, Artificial Sequence; identical to SEQ ID NO: 9787
  Synthetic polypeptide

SEQ ID NO: 14941 - DNA, 1403 bp, Artificial Sequence; identical to SEQ ID NO: 9788
  Synthetic polypeptide

SEQ ID NO: 14942 - DNA, 1355 bp, Artificial Sequence; identical to SEQ ID NO: 9789
  Synthetic polypeptide

SEQ ID NO: 14943 - DNA, 698 bp, Artificial Sequence; identical to SEQ ID NO: 9922
  Synthetic polypeptide

SEQ ID NO: 14944 - DNA, 779 bp, Artificial Sequence; identical to SEQ ID NO: 9923
  Synthetic polypeptide

SEQ ID NO: 14945 - DNA, 2109 bp, Artificial Sequence
  Synthetic polypeptide
ctggaatgttgctgcagcacctgtctgccagcttccaccctgggccccaatcgtgtcctcagcaccacaacagagggatcctccaacagctcagccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttga

SEQ ID NO: 14946 - DNA, 713 bp, Artificial Sequence
  Synthetic polypeptide
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatgggttctggctccttggcagcaatggctgtatttgaagataagtttaggccagacatggaggaggaggaagccaagaatctggtgagcgaagccatcgcagctggcatcttcaacgacctgggctccggaagcaacattgacctctgcgtcatcagcaagaacaagctggattttctccgcccatacacagtgcccaacaagaaggggaccaggcttggccggtacaggtgtgagaaagggactactgcagtcctcactgagaaaatcactcctctggagattgaggtgctggaagaaacagtccaaacaatggacacttcctga

SEQ ID NO: 14947 - DNA, 308 bp, Artificial Sequence
  Synthetic polypeptide
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggttctggctccttggcagcaatggctgtatttga

SEQ ID NO: 14948 - DNA, 510 bp, Artificial Sequence
  Synthetic polypeptide
tgtgatgggagatcacgagatttggggtcagacaggatggcatagttcttggagcagatacaagagcaactgaagggatggttgttgctgacaagaactgttcaaaaatacacttcatatctcctaatatttattgttgtggtgctgggacagctgcagacacagacatgacaacccagctcatttcttccaacctggagctccactccctctccactggccgtcttcccagagttgtgacagccaatcggatgctgaagcagatgcttttcaggtatcaaggttacattggtgcagccctagttttagggggagtagatgttactggacctcacctctacagcatctatcctcatggatcaactgataagttgccttatgtcaccatggtccattgtgaagaggagctctttacagagaatcttttctttattaggcaagctgaagtagtgtcagaagaagcttggggaccatcttttgctattagcttggcagtgttccttgtagcag

SEQ ID NO: 14949 - DNA, 2133 bp, Artificial Sequence
  Synthetic polypeptide
tgagaggtgacagcgtgctggcagtcctcacagccctcgctcgctctcggcgcctcctctgcctgggctcccactttggtggcacttgaggagcccttcagcccaccgctgcactgtgggagcccctttctgggctggccaaggccagagccggctccctcagcttgcagggaggtgtagagggagaggcgcgagcgggaaccggggctgtgcgcggcacttgtgggccagctggagttccgggtgggcgtgggcttggcaggccgcgcacgccgagcagccggccagccctgccggcccgggcaatgaggggcttagcacctgggccagcggctgcggtggttgtactgggtcccccagcagtgccagctcaccagcgctgcgcttgatttctcactgggccttagctgccttcccgcggggcatggctggggacctgcagcccgccatgcctgaacctcccaccccctccatgggctcctgtgcggccggagcctccctgatgagcgccaccccctgctccacggtgcccagtcccatcgaccacccaagggctgagtagtgcgggcgcacagcacgggactggcaggcagctccacctgcagcccctgtgcaggatccactgggtgaagccagctgggctcctgagtctggtggggccttggagaacctttatgtctagcccagggattgtaaatacaccaattggcattctgtatctagctcaaggtttgtaaatacaccaatcagcaccctgtgtctagctcagggtttgtgaatgcaccaatcgacactgtatctagctactctggtggggccttggagaacctttgtgtggacactctgtatctgtctaatctggtggggacgtggagaacctttgtgtctagctcagggattgtaaacacaccaatcagtgccctgtcaaaacagaccactcggctctaccaatcagcaggatgtgggtggggccagataagagaataaaagcaggctactggagccagcagtggcaacccgctcgggtcctcttcaacactgtggaagctttgttctttcgctcttttgcaataaatcttgctactgctcactctttgggtccacactgcctttatgagctgtaacactcaccgcgaaaggtctgcagcttcactcctgaagccagcgagcccacgagcccacagggaggaatgaacaactccagatgcaccgccttaagagctgtaacactcacggcgaaggtctgcagcttcactcctgagccagcgagaccaggaacccaccagaaggaagaaactccgaacacatccgaacatcagaaggaacaaactccagacggcgccaccttaagagctgtaacactcaccgccagggtccggggcttcgttcttgaagtaccatgatcaacaggatgttactagcaacttccttggagcgatgtggttgatatcaataacttttctctccattggttatggtgacatggtacctaacacatactgtggaaaaggagtctgcttacttactggaattatgggtgctggttgcacagccctggtggtagctgtagtggcaaggaagctagaacttaccaaagcagaaaaacacgtgcacaatttcatgatggatactcagctgactaaaagagtaaaaaatgcagctgccaatgtactcagggaaacatggctaatttacaaaaatacaaagctagtgaaaaagatagatcatgcaaaagtaagaaaacatcaacgaaaattcctgcaagctattcatcaattaagaagtgtaaaaatggaacagaggaaactgaatgaccaagcaaacactttggtggacttggcaaagacccagaacatcatgtatgatatgatttctgacttaaacgaaaggagtgaagacttcgagaagaggattgttaccctggaaacaaaactagagactttgattggtagcatccacgccctccctgggctcataagccagaccatcaggcagcagcagagagatttcattgaggctcagatggagagctacgacaagcacgtcacttacaatgctgagcggtcccggtcctcgtccaggaggcggcggtcctcttccacagcaccaccaacttcatcagagagtagctag

SEQ ID NO: 14950 - DNA, 1084 bp, Artificial Sequence; identical to SEQ ID NO: 580
  Synthetic polypeptide

SEQ ID NO: 14951 - DNA, 2825 bp, Artificial Sequence
  Synthetic polypeptide
attgcttctcggccttttggctaagatcaagtgttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 14952 - DNA, 614 bp, Artificial Sequence
  Synthetic polypeptide
aaattggagtttcactgaagaataagaaactcactcaaaaccacacaactacatggaaattgaacaaccttctcctgaatgactcctgggtaaataatgaaatcaaggcagaaatcaagaagttctttgaaaccaaagagaacaaagaaaacctctgggatgcagctaaagcagtggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 14953 - DNA, 2162 bp, Artificial Sequence; identical to SEQ ID NO: 14719
  Synthetic polypeptide

SEQ ID NO: 14954 - DNA, 1541 bp, Artificial Sequence; identical to SEQ ID NO: 14720
  Synthetic polypeptide

SEQ ID NO: 14955 - DNA, 401 bp, Artificial Sequence; identical to SEQ ID NO: 14721
  Synthetic polypeptide

SEQ ID NO: 14956 - DNA, 443 bp, Artificial Sequence; identical to SEQ ID NO: 14722
  Synthetic polypeptide

SEQ ID NO: 14957 - DNA, 472 bp, Artificial Sequence
  Synthetic polypeptide
tgatgtggtttggctgtgtccccgctaaaatctcaacttgaattgtatctcccagaattcccatgtgttgtgggagggacccagggggagttaactgaatcatgggggccggtctttcctgtgctattctggtgatagtgaataagtctcacgagatctgatgggtttatcaggggtttccacttttctgtctccctcattttctcttgctgccaccatgtaagaagtgcttttcacctccccccatgattccgaggcctccccagccacatggaactaaccaggacatcagaggaagaaaatcagcagacagaaaaatactggggaaaaaaaaatgccacgtggttctgttcagctgagcttctgctccctccagcacccccacatgggacatttgtttaccccccacgatgctgctcttggagagtcccaggggacaggtttcaagcccttagggatgcagcctgtctaa

SEQ ID NO: 14958 - DNA, 367 bp, Artificial Sequence; identical to SEQ ID NO: 548
  Synthetic polypeptide

SEQ ID NO: 14959 - DNA, 1055 bp, Artificial Sequence
  Synthetic polypeptide
gccctgagctgctgacatggcctccagaaacatctttgggagcctttggtcttctgtgggatctcattgtggatggaatcttccttcagcctgatgaagacaagcacctgtggtgcccctcactgcaagaagtcagggaggcattccacagcctgggtgcccacagtcctgccctgtaccctctggggcccttttggcacggtggcagggtgcttccaggcgaggctggcctgaatgagaatgaggagcaggacgctccccaagagattgccttggacatcagcctgggccacatctacaagtttctggcgctgtgtgcccaggcccagccgggggcctacactgatgagaacctcatgggactgattgagctgctgtgccgcaccagcctggacgtggggctccgcctgctgcccaaagttgacctccagcagcttctcctcttgctcctggagaacatccgggagtggccagggaagctccaggaactgtgctgcaccctgagctgggtgtctgaccaccaccacaacctgctggccctcgtgcagttcttcccagacatgacctcccggagcaggcggcttcgaagccagctcagccttgtggtcattgctcgaatgctgggccagcaggagatgctccctctctggcaagagaagacccagctgtcctcgctcagccggctcctgggcctcatgaggccatcatctctcaggcaatacctggactctgtgcccttgccaccctgccaggagcaacagccaaaggctagtgccgagctagaccacaaggcctgctacctgtgccacagcttgctgatgctggccggggtagttgttagctgccaggacatcactccagaccagtggggcgagctgcagctgctgtgcatgcagttggaccgccacatcagcacgcagatccgggagagcccccaggccatgcaccgcaccatgctcaaggacctggctacccagacctacatccgttggcaggagctgctgacccactgccagccccaggcccagtatttcagcccctggaaagacatctaa

SEQ ID NO: 14960 - DNA, 157 bp, Artificial Sequence
  Synthetic polypeptide
ggccgggtgcggtggctcacacctgtaatcctagcatcttgggaggctgaggcaggaggatcgcttgagcccaggagtttgagaccagcctaggcaacataaggagaccccatctctacaaaatatcaaaaaattacccagaagactcactccatag

SEQ ID NO: 14961 - DNA, 757 bp, Artificial Sequence
  Synthetic polypeptide
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaagttacatcatgctgatgacagcttcctggtcctcaccacagatggaattaacttcatggtgaatagtcaagagatttgtgactttgtcaatcagtgccatgatcccaacgaagcagcccatgcggtgactgaacaggcaatacagtacggtactgaggataacagtactgcagtagtagtgccttttggtgcctggggaaaatataagaactctgaaatcaacttctcattcagcagaagctttgcctccagtggacgatgggcctga

SEQ ID NO: 14962 - DNA, 622 bp, Artificial Sequence
  Synthetic polypeptide
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgcaactcttctgacctctgggactactgcaacagtagccctattgcgagatggtattgaactggttgtagccagtgttggggacagccgggctattttgtgtagaaaaggaaaacccatgaagctgaccattgaccatactccagaaagaaaagatgaaaaagaaaggatcaagaaatgtggtggttttgtagcttggaatagtttggggcagcctcacgtaaatggcaggcttgcaatgacaagaagtattggagatttggaccttaagaccagtggtgtcatagcagaacctgaaactaagaggattaaggcaatacagtacggtactgaggataacagtactgcagtagtagtgccttttggtgcctggggaaaatataagaactctgaaatcaacttctcattcagcagaagctttgcctccagtggacgatgggcctga

SEQ ID NO: 14963 - DNA, 340 bp, Artificial Sequence
  Synthetic polypeptide
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatgagaactgtgcctggtcagcagctctagacctggagcccgtggacactatatgcggggcttcagtggaaagagagatctgcttaattttgtcccaggtgaaggagtccagcggttcctatcctggactacgggaaggttcccacatctctttgtcccattag

SEQ ID NO: 14964 - DNA, 187 bp, Artificial Sequence
  Synthetic polypeptide
aggacaaggacttggactttcattgttgtgcccttaaaagcttatcacagtgcctgatactttgtggattctcaatagggatttgcttcctaaggagaagaacttggaaactctgttgaccttggcttttctagaaatagataaagccttttcgagtcatgcccgcctgtctgctgatggtatgtaa

SEQ ID NO: 14965 - DNA, 2051 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14966 - DNA, 2030 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14967 - DNA, 2051 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14968 - DNA, 1925 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 14969 - DNA, 932 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 14970 - DNA, 1076 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 14971 - DNA, 941 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 14972 - DNA, 497 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 14973 - DNA, 439 bp, Artificial Sequence
  Synthetic polypeptide
ttagccaggcttggtggtgagcacctgtggtcctagccacttgggaggctaatgaggaagatggcttcagcctaggagtttgaggctgcagtgagtgatgaacgtgccactgcacgcaggtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 14974 - DNA, 1441 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagaaacttcgggaaaaacaaaaagttatacgagaaagtcatggtccaaatatgaaacaagcaaaaatgtggcgtgatttggaacaattaatggaatgtaagaaacagtgctttctgaaacaacaaagccaaacttccattggtcaggtaattcaggagggtggggaggaccggctaatactgtga

SEQ ID NO: 14975 - DNA, 1375 bp, Artificial Sequence
  Synthetic polypeptide
ctctgcctctccccatggtctccctctccccacggtctccctctccccacggtctccctctccctctctttccacggtctccctctgatgccgagctgaagctggactgtactgctgccatctcggctcactgcaacctccctgcctgattctcctgcctcagcctgccgagtgcctgcaattgcaggcgcgcgccgccacgcctgactggttttcgtatttttttggtggagacagggtttcgctgtgttggccgggctggtctccagctcctaaccgcgagtgatccgccagcctcggcctccggaggtgccgggattgcagatggtgtctggttcactcagtgctcaatggtgcccaggctggagtgcagtggcgtgatctcgtgtcgctacaacctccaccccccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtctggaaagtgaggagcgtctccgcccggcagccgccccgtccgggagggagttcaaacgatatgtcaataaacttcgaagcaagagtacagttttcaaaaagaagcatcagataatagctgaacttaaagctgaattcggtcttttgcagaggactgaagaacttcttaagcaacgtcatgaaaatattcaacaacaactgcaaactatggaggagaaaaagggtatatctggatatagttacacccaagaagagctagaaagagtatctgcactgaagagtgaagttgatgaaatgaaaggacgaacattggatgatatgtctgaaatggtgaaaaaactgtattcattggtatctgaaaagaagtcagctcttgcctcagttataaaagagctacgacagttgcgtcaaaaatatcaagaactgacccaggagtgtgatgaaaagaaatcccagtatgatagctgtgcagcaggcctcgaaagcaatcggtccaaattagaacaggaagttagaagactccgtgaagaatgtcttcaagaagaaagtagataccattatacaaattgtatgattaagaacctagaagttcaacttcgtcgtgctactgatgagatgaaggcatatatctcttctgatcaacaagaaaaaagaaaggcaattagggaacagtataccaaaaatactgctgaacaagaaaaccttggaaagagacggaatctcactctgttgcccaggctggagtgcagtggcacaatcttggctcactctgccttccagtacagatgggatttcaccatgttggccaggctggtctcgaactcctga

SEQ ID NO: 14976 - DNA, 170 bp, Artificial Sequence
  Synthetic polypeptide
ggctgggcatggtggctcacacctgtaatcccagcacttcgggaggccgaggtgggtggatcacctgatctcaggagctcgagaccagcctggcaaacatggttcccaatgctccacctgcttatgagaaactctctgcagaacagtcaccaccaccttattcaccttaa

SEQ ID NO: 14977 - DNA, 359 bp, Artificial Sequence
  Synthetic polypeptide
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggaggaaactgaagagacatcctcacaagagtctgccgaagaggactag

SEQ ID NO: 14978 - DNA, 329 bp, Artificial Sequence
  Synthetic polypeptide
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggtaagacatagtcattaa

SEQ ID NO: 14979 - DNA, 386 bp, Artificial Sequence
  Synthetic polypeptide
tgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactccacaacaagttgttcagaagaagcctgctcaggtcaatgttgccttgcctgggaaggaccacccgggcaatcttatatatctactgttctctaaaaatgccacttag

SEQ ID NO: 14980 - DNA, 899 bp, Artificial Sequence
  Synthetic polypeptide
gaattccaatagtccttatcagtggcagaagatccttctgtagtatattttcagtgctgccgtatcgcgacagtacccaagtcggggacttgaagttggacggaggaagacaatcaactggtgcagtgagtttgaaagagatcattggtctggaaggtgtggagctgggtgctgatgggaagactgtttcctatacccaatttctgttacccacaaatgcctttggagcccggagaaataccatagactccacctcctctttctcccagttccgtaacctgagccaccgcagcctctccataggccgggcaagcggcacccaggggagcctcgacacaggtagtgacctgggagactttatggactatgacccaaatctcttggatgacccccagtggccttgtggcaaacacaaacgcgttctgatcttcccttcctacatgacaacagtgattgactacgtgaagccctcggatctcaagaaggacatgaacgagaccttcaaggagaagtttcctcacattaagctgacactcagcaaaattaggagtctgaaacgagagatgcggaagcttgcgcaggaggactgtggccttgaggagcccacggtggccatggccttcgtctactttgaaaagctcgccctcaaggggaaactcaacaaacagaaccggaagctgtgtgctggggcatgtgtgctgttagcagccaaaattggaagtgacctcaaaaaacacgaagtcaagcatttaattgacaaactggaagagaagttccggctgaacaggcgagaactgattgcctttgaattcccggtgttagtggccttggaattcgccctccacttgcccgagcacgaagtcatgccccactacagacggctggtccagagttcctag

SEQ ID NO: 14981 - DNA, 95 bp, Artificial Sequence
  Synthetic polypeptide
gaattccaatagtccttatcagtggcagaagatccttctgtagtatattttcagtgctgccgtatcgcgacagtacccaagtcggacaacagtga

SEQ ID NO: 14982 - DNA, 149 bp, Artificial Sequence
  Synthetic polypeptide
gaattccaatagtccttatcagtggcagaagatccttctgtagtatattttcagtgctgccgtatcgcgacagtacccaagtcgggtatgtatatgcatgcatgctttgtagttctctgggtgaaaagatctcacaccaatgtacataa

SEQ ID NO: 14983 - DNA, 2073 bp, Artificial Sequence
  Synthetic polypeptide
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcagagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 14984 - DNA, 117 bp, Artificial Sequence; identical to SEQ ID NO: 9461
  Synthetic polypeptide

SEQ ID NO: 14985 - DNA, 1412 bp, Artificial Sequence
  Synthetic polypeptide
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagggaatgcccaaggcgtcattcaataatgaatctagtttgagagaattgtcaggaacgccaaatttactgaatacaagtgactcagagcaggctcagaaaccagtgtcccctcctggagaagcaagtacctctggacagcactctagactaaaactggaactcaggaggaaggagactgaaggaaagatgtatagcctgcgagaaagaaagggtcatgcatacaaagagatcagcgagccacaggatgatgactacctctattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgaggtatgtgaactgtgcccgggatgatgaagagcagaacctggtggccttccagtaccacaggcagatcttctatagaacctgccgagtcattaggccaggctgtgaactgctggtctggtctggggatgagtatggccaggaactgggcatcagatcttctatagaacctgccgagtcattaggccaggctgtgaactgctggtctggtatggggatgagtatggccaggaactgggcatcaagtggggcagcaagtggaagaaagagctcatggcagggagagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttga

SEQ ID NO: 14986 - DNA, 350 bp, Artificial Sequence
  Synthetic polypeptide
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagtcaaacctccttggatggccttcagaggagaacagagtaaacaccagaagattgtgagatgtgtcagaacttcttcattgacagctgtgctgctcatgggccccctacatttgtaa

SEQ ID NO: 14987 - DNA, 279 bp, Artificial Sequence
  Synthetic polypeptide
ctgatggttttataaaggggagtttccctacacaagctcttttgcctgctgccatgtaagagatgtgactttgttcctcacctgccttctgccatgagtgtgaggcctctccgaccatgtgcaactgtctcagagccactcgaccagctttcatgtgtcaccgaaggcaggccatcaaactccaggtggatgacacagaagattccgatgaagaatggacacctaggcagcaagacagagtttcgctcttgtcaccccggctggagtgcaatggcgtga

SEQ ID NO: 14988 - DNA, 6107 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14989 - DNA, 6026 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14990 - DNA, 6182 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14991 - DNA, 6098 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14992 - DNA, 6101 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 14993 - DNA, 683 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggagtttgccagggtttggatacctgatccagaggaagtctggaagtcagcagagctgctcaaagattataagccaggagataaagtcctcctgcttcacctcgaggaaggaaaggtatag

SEQ ID NO: 14994 - DNA, 3222 bp, Artificial Sequence; identical to SEQ ID NO: 14669
  Synthetic polypeptide

SEQ ID NO: 14995 - DNA, 1287 bp, Artificial Sequence; identical to SEQ ID NO: 14670
  Synthetic polypeptide

SEQ ID NO: 14996 - DNA, 6602 bp, Artificial Sequence
  Synthetic polypeptide
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 14997 - DNA, 5960 bp, Artificial Sequence
  Synthetic polypeptide
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 14998 - DNA, 3305 bp, Artificial Sequence
  Synthetic polypeptide
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacagctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 14999 - DNA, 2693 bp, Artificial Sequence
  Synthetic polypeptide
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtag

SEQ ID NO: 15000 - DNA, 2201 bp, Artificial Sequence
  Synthetic polypeptide
catgtaagcagcaaccacagaaagtgagagtggttataatggattcagacaaaacatactttaaagcaagaaaatgtaactagagatattaagaacattttataatgataaatgggacaatcgatcaggaagttacaacaaatataaacatatatgtacctaaaacagcaccaaaatgcatgaagcaaaactgacataaacaaagggagaagtagacaattcaacatgacagttggagacttcaataccccactttcaataatgcatagatcacctaaacagaagaccaacaagggaatagaaagcttgaacaacatcataaaccaattaggcttaacagataactatagagcacaccacccagtaacaatagaaaacacattcttctcaagtgcatatggaacattctccagcatagaccatgtgttagtccattaaaaagcctcaaaatatctaaaaggatagaaataatacaaactgtcctccaaccacaatgtaataaaattagaaataagaaaccaataggaggaaaaaaattggaaactcataaatatgtgaaaattaatacactaccagataaccactaggttaaagaaaatgtcagaaggttaattagaaaatacttttaggtaaatggaaatgaagacataacaaaccaaaacttaggggatgcaggtaaagtagtacggacagggaaatttatacctgtaaatacctatattaagaaagatatttaataagtaacataactttctaccttaagacactggaaaaagaagagtaaactaaacctaaagcaagtagagggaaggagataatgattaaagtggaattaatggaaaagagaatagaaaagtagagaaattcaatgaaattaaaagctcttctttaaaaacctcaacaaaattcacatatctttagctagagtcataaaagaagagaaagataagactcaaatgactagactcagaaatgaaagaggggacattactaccaaccttatagaaatgagtatgaaagaatactatgacttatatgcaaacaaattagataacttagatgaaatgggaaaattctgagaaatatacaatctgccaaaactgactcaagaaaaaatgtacaatctgaacagatctataaggagtaaagagataggattagtaataaaaaaactgtccaaagaaaagcccaggcccacatggctttttcgatgaattctaaaaaacatttaaggaagagttaataccaattcttcacaaactcttcaagaaaatagcagagaagggaacatttcccaactcatttaatgaggccagtactacccagataccaaactagacaaagatatcacaagatagaaaactatagatcaatatctattatgaacatgggtgcagaaattctgaacaaaatactatcaaaccaaatccagcaacatataaaaataatgatacaccatgaccaagcagggtttatcccaggaatgtaaagttggtttacattagaaaaataaataatgtaatatagcatatcaatatagtagaaacaaaaatcacatgatcttttcaataggcacagcaaaagacttggataaaactcaacactctttataaaaaatcactcggaaaaccaggaatagaagggaacttcctcaacccgataaagaacagctataaagaatccacagttaacatcagacttaatggtgaaagattgctttcctcctaagattaggaacaagataaggatgtcctctctcgctacttctattcaacattttaatggaagtacaggccaaagcaattaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaa

SEQ ID NO: 15001 - DNA, 232 bp, Artificial Sequence
  Synthetic polypeptide
gtgaggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttccagcagggcttcagtga

SEQ ID NO: 15002 - DNA, 277 bp, Artificial Sequence
  Synthetic polypeptide
gtgaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatga

SEQ ID NO: 15003 - DNA, 172 bp, Artificial Sequence
  Synthetic polypeptide
gtgaggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtga

SEQ ID NO: 15004 - DNA, 728 bp, Artificial Sequence
  Synthetic polypeptide
tgatatggtttggctgtgtccccacccagatgtcatgttgaattgtgttgaattgtaatccccaatgttgggggagggacctggtgggaggtgattggatcatgaagatggatatccctcttgctgtcctcgtgatagtaagttctcacaagatctggctgtttaaaagtgtatagcactttcctcttcactcctctctgctgctggccatgtgaagatgtgctggcttccccttcaccttctcccatgattggaagtttactgaggcctccccagttgttcttctatacagcctgcagaactaagagaagctgaatttggacgacagccagtgggaggacatccacgttgtcaccggagcactgaagatgtttttccgggagctgcctgagccgctcttcccttacagtttctttgagcagtttgtggaagcgatcaaaaagcaagacaacaacacaagaattgaagctgtaaaatctcttgtacaaaaactccctccgccaaatcgtgacaccatgaaagtcctctttggacatctaactaagatagtggccaaagcctccaagaacctcatgtccacgcaaagcttggggattgtatttggacctacccttctgcgagctgaaaatgaaacaggaaacatggcgatccacatggtctaccagaaccagatagctgagctcatgctgagtgagtacagtaagatcttcggctcagaggaagactga

SEQ ID NO: 15005 - DNA, 948 bp, Artificial Sequence
  Synthetic polypeptide
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagaaaacaaaaaaaaggacagcaatcccaattcctgcaaagccgtaa

SEQ ID NO: 15006 - DNA, 1287 bp, Artificial Sequence
  Synthetic polypeptide
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcaggtggtagatctactagtatccatgtgtaggtctgcgttggaatctcctagaaaagttgtgattttcgagccatatccttctgtggtagatcctaatgatcctcagatgttggccttcaaccccaggaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 15007 - DNA, 1161 bp, Artificial Sequence
  Synthetic polypeptide
gctatagactggatgtgttcctcccagaattcatacattgaaatcctaactcccatgtgatggtgttaggagatgggttgtttggaaggcgattaggtcatgagggtggtgccctcatgaacaggaatagtgcctttgtaatagagcacaaagagctctctcactcctctaccatgaaaggacacagcaagaagatcaatttgtggccttactgtcactctggtctatgaatcagcagatgggccctcatcaggcactgaatctcctgacatctttatcttcccagccttcaaaactcctaccgtatgtgaacgggagctgtgtgtgtttgcttttcaaaccctgggagtaatgaatgaagctgctgatgaaatagcaactggagctcagaaaaagaactatgatcgagtaatgaaagcactggatagcataacttctatcagagaaatgacacaagcaccatatctggaaatcaagaagcaaatggataaacaggacccccttgctcatcccttactgcaatgggttatatcaagtaatagatcacatattgtgaaactgccagttaacaggcaattgaagtttatgcatactccacatcagttccttcttctcagcagtccaccagccaaagaatccaattttagagctgctaaaaaactctttggaagcacctttgcatttcatggctcacacattgaaaactggcactccatcctgaggaatggtctggttgttgcttctaatacacgattgcagctccatggtgcaatgtatggaagtggaatctatcttagtccaatgtcaagcatatcatttggttactcagggatgaacaagaaacagaaggtgtcagccaaggacgagccagcttcaagcagtaaaagcagcaatacatcacagtcacagaaaaaaggacagcaatcccaattcctgcaaagccgtaacttaaaatgcatagccttatgtgaagtgatcacctcatctgacctgcacaaacatggagagatatgggttgtccccaatactgaccatgtctgcacacgattctttttcgtctatgaagacggccaagtgggagatgcaaatattaatacacaagaaggaggcattcacaaagagatcctccgagtaattggtaatcaaactgctactggttaa

SEQ ID NO: 15008 - DNA, 2738 bp, Artificial Sequence; identical to SEQ ID NO: 13465
  Synthetic polypeptide

SEQ ID NO: 15009 - DNA, 629 bp, Artificial Sequence; identical to SEQ ID NO: 13466
  Synthetic polypeptide

SEQ ID NO: 15010 - DNA, 918 bp, Artificial Sequence; identical to SEQ ID NO: 13467
  Synthetic polypeptide

SEQ ID NO: 15011 - DNA, 740 bp, Artificial Sequence
  Synthetic polypeptide
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 15012 - DNA, 719 bp, Artificial Sequence
  Synthetic polypeptide
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 15013 - DNA, 552 bp, Artificial Sequence
  Synthetic polypeptide
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcg

SEQ ID NO: 15014 - DNA, 194 bp, Artificial Sequence
  Synthetic polypeptide
tctccacccactctgtagttgttacacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 15015 - DNA, 572 bp, Artificial Sequence
  Synthetic polypeptide
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccaggaaacatacctacagaccattctgtttctgtggctgctggagactccagtcgtgggcatcttggacaaagggacttttccagcagggcttcagtga

SEQ ID NO: 15016 - DNA, 617 bp, Artificial Sequence
  Synthetic polypeptide
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccagaaagctgatggtgtgcccgtctacctgaaacgaggcctgcctgaccaaatgctttaccggaccaccatggcgctgactgtgggagggaccatctactgcctgatcgccctctacatggcttcgcagcccaaaaacaaatga

SEQ ID NO: 15017 - DNA, 512 bp, Artificial Sequence
  Synthetic polypeptide
tgccatagactgaattgtgccccctacctccaaattcatatgttgaacccctaactcctggtgtgactgtatttgaggatagggctcttaggaagtaattaaggttaaatgcaatcataggattctactctaataggactggtggcctcacaagaagagacaagaagaaagctgtctctgtgcacacacaccgaggaaaagccatgtgagcacacagcgaaaaggcagccgagcccacaagccaggaagagagccctgcaccccagaactcaactgtgagaacatacattcctgttgtttaagccaccagtctgtggtattttatggcagcccaagctaagacaggattaaagcctgtggtttccacagaagcaccacctatcatatttgccacaccaactaaactgacctccgattccacagtgtatgattatgctgggaaaaacaaagttccagagctacaaaagtttttccaggtgagggaagatactctacaacagaaaagcctgtga

SEQ ID NO: 15018 - DNA, 6263 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15019 - DNA, 6182 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15020 - DNA, 6338 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagttacatgagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15021 - DNA, 6254 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaagaatacaatgacagattccacaatacttttggaagatgtacaaaaaatgaaagataaaggtgaaatagcacaagcatacattggtttgaaagaaacaaatagatcatctgctctggattaccatgagttgaatgaggatggagagctgtggctggtttatgaagggttaaaacaagccaacaggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttggatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15022 - DNA, 6257 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggatttggaataccatctagatccaaagaccaaggagctgcctcacttacgaaatcctgacatacttgttggtgaaaatgacctcacagccctcagctatcttcatgagcctgctgtgctccataatctcagagtccgctttattgattccaaacttatttatacgtattgtggtatagtcctagtagctataaatccctatgaacagctgcctatttatggagaagatattattaatgcatacagtggtcagaacatgggtgatatggatccacatatctttgcagtagctgaagaagcttacaagcaaatggccagagatgaacgaaatcagtccatcatcgtaagtggagagtctggggcaggaaaaacagtctcagctaagtatgccatgcgatactttgcaactgtgagtggttctgccagtgaggccaatgtggaggaaaaggtcttggcctccaaccccatcatggagtccattggaaatgctaaaacaaccaggaatgataatagcagccgttttgggaagtatattgagattggttttgataagagatatcgaatcattggtgccaatatgagaacttatcttttagagaaatccagagtggtattccaggcagaagaggagagaaactatcatatcttctatcagctttgtgcctcagcaaagttacctgaatttaaaatgctacgattaggaaatgcagataactttaattacacaaaacaaggaggcagtcctgtgattgaaggagtggatgatgcaaaggagatggcacatactaggcaggcctgcactttgctaggaattagtgaatctcatcaaatgggaattttccgaatacttgctggcatccttcacttaggcaatgttggatttacatcccgagatgcagacagctgcacaatacctcccaagcatgaacctctctgcatcttctgtgaactcatgggtgtggactatgaggagatgtgtcactggctctgccatcggaaactggctactgccacagagacatacatcaagcccatctccaagctgcaggccacaaatgcccgcgatgctttggccaagcacatctatgccaagctctttaactggattgtagataatgtcaatcaggctctccattctgctgtcaaacagcactcttttattggtgtgctagacatttacggatttgaaacatttgagataaatagttttgaacagttttgcataaattatgcaaatgaaaaactacagcaacaattcaatatgcatgtcttcaaattggagcaagaagaatatatgaaggaacaaattccatggacactcatagatttttatgataatcagccttgtattaatcttatagaatcaaaactaggcattctagatttactggatgaggaatgcaagatgcctaaaggcacagatgacacctgggcccaaaaattgtacaacacacatttgaacaaatgtgcactctttgaaaagcctcgtctatcaaacaaagctttcatcatccaacattttgctgacaaagtggaataccagtgtgaaggatttctcgaaaagaataaagacaccgtttttgaagaacaaattaaagttcttaaatcaagcaagtttaagatgctaccagaactatttcaagatgatgagaaggccatcagtccaacttcagccacctcctcagggcgcacacccctcacacgaactcctgcaaagcccaccaaaggcagaccaggccaaatggccaaagagcacaagaaaacagtggggcatcagttcagaaactccctgcacctgcttatggagacactcaatgccactacccctcactatgtgcgctgtatcaagcctaatgacttcaagttcccattcacgtttgatgagaagagggcagtgcagcagctgagagcatgtggtgtcctggaaaccatccgaatcagtgcggccggtttcccctcacggtggacttaccaagaatttttcagccgctaccgtgtcctaatgaagcagaaagatgtgctgagtgacagaaagcaaacatgcaagaatgtgttagagaaactgatactggacaaggacaaataccagtttggtaagacaaagatctttttccgtgccggtcaagtggcctatctagaaaaattgagagctgacaaactgagagctgcctgcatccggatccagaagaccatccgagggtggctgctgagaaagaagtacctacgcatgcggaaggcagccatcaccatgcagagatacgtgcggggctaccaggcccgatgctatgctaagtttctgcgcagaaccaaggcagcaaccatcattcaaaagtactggcgcatgtatgtggtccgcaggaggtacaagattagacgagctgccactatcgttcttcagtcttacttgcgaggcttcttggccagaaataggtatcgcaagatactccgtgagcacaaagcagtcatcattcagaagcgagtccggggctggctggcccgcacacactacaagaggagcatgcatgccatcatctaccttcagtgctgcttcaggcggatgatggccaagcgtgagctaaagaagctcaaaatcgaggctcgctcagtggagcgctataagaagctgcacatcggcatggagaacaagatcatgcagctgcagcgcaaagttgatgagcagaacaaagactacaaatgccttgtggagaaactaaccaatctggaaggaatatacaactctgagactgagaaactacgaagtgacttagaacgtcttcaactaagtgaagaggaagcgaaagttgccactgggcgggtccttagtctgcaggaagaaattgccaagctccggaaagacctggagcaaactcgttcagagaaaaaatgcattgaggaacatgcagatcgatacaaacaagaaacagagcagctggtatcaaatctgaaggaagaaaatactttgctgaagcaagaaaaagaagccctcaatcaccgcatcgtgcagcaggctaaggagatgacagaaactatggagaagaagttagtagaagaaacgaaacaactggaactcgaccttaatgatgaaaggctgagatatcagaaccttctgaatgagttcagtcgcctggaagaaagatatgatgacctcaaggaagagatgacccttatggtgcatgtgcctaagcctggacacaagagaacagactccacccacagcagcaacgagtctgaatatatctttagctctgaaattgcagaaatggaagacattccatcaaggacagaggaaccaagtgagaagaaggtacctctggacatgtcattgttccttaagctccagaagcgggtcacagagctggagcaggagaagcaggtgatgcaggatgagctggaccgcaaggaggagcaggtgctccgcagcaaggccaaggaagaagaaagaccacaaattagaggtgcagaactggaatatgagtcactcaagcgtcaagaactagaatcagaaaacaaaaaactgaagaatgagctaaatgagttgcgcaaggccctcagtgagaaaagtgccccagaggtgaccgccccaggtgcacctgcctaccgtgtcctcatggagcagctgacctctgtgagcgaggagcttgatgtccgcaaggaggaagtcctcatcttaaggtctcaactggtgagccagaaagaggccatccaacccaaggatgacaagaatacaatgacagattccacaatacttttggaagatgtacaaaaaatgaaagataaaggtgaaatagcacaagcatacattggtttgaaagaaacaaataggctcctggaatcccagctgcagtcacagaagaggagccatgagaatgaggccgaggccctccgtggggagatccagagcctgaaggaggagaacaaccgacagcagcagctgctggcccagaacctgcagctgcccccagaggcccgcattgaggccagcctgcagcacgagatcacccggctgaccaacgaaaacttgtattttgaggaattatatgcagatgaccctaagaagtatcaatcatatcggatttccctttacaaacggatgattgatttgatggaacaacttgaaaaacaggataagacggtccgtaaactgaaaaaacaactgaaagtatttgccaaaaaaattggcgaactagaagtgggccagatggagaacatatccccaggacagatcattgatgaacccatccgaccagtcaacattcccaggaaagaaaaggatttccaagggatgctggaatacaagaaggaggatgagcaaaaacttgttaagaacctgattctggaactgaagccacgtggtgtagcagtcaatttgattccaggattaccggcatatatcctgttcatgtgtgttcgacatgctgactacctgaatgatgatcagaaagtaaggtcgttgctaacatcaacaattaacagcatcaaaaaagtattgaagaaaagaggtgatgattttgaaaccgtctccttctggctctctaacacatgccgatttttgcactgcttgaaacagtacagtggagaagagggctttatgaagcacaacacatctcgccagaatgaacactgcctcaccaattttgacctggctgagtatcggcaggtgctgagtgacttggccattcagatctaccagcagctcgtgcgggtgttagagaacatccttcagccaatgattgtctcaggcatgctggaacatgaaacgattcagggcgtgtctggggtgaagcccacagggttgagaaagcgaacctccagtatcgccgatgagggcacctacacactggactccatcctccggcagctcaactccttccactcggtcatgtgtcagcatggcatggaccctgaactgatcaagcaggtggtcaagcagatgttctacatcataggggccatcaccctgaacaaccttctcctgcggaaggacatgtgctcctggagtaaaggcatgcagatcaggtacaatgtcagtcaactggaagaatggctgcgtgacaagaatctgatgaatagtggggctaaagaaaccctggaacctctcattcaggctgctcaacttttgcaagtgaaaaagaaaacagatgatgatgcagaagccatttgttctatgtgcaatgctttaactactgcccagattgtgaaagtgttgaatttgtatactccagttaatgagtttgaagaaagagtctctgtgtcgttcattcgtactatacagatgcgtttacgagacaggaaagactctccccagctgctcatggatgctaaacacatctttcctgtcacctttcctttcaacccatcttccctcgcactagaaaccatccagattccagccagcctcggcctgggcttcatttcacgggtctga

SEQ ID NO: 15023 - DNA, 839 bp, Artificial Sequence
  Synthetic polypeptide
cctcgccctcgccctcgccctcgcacggtcctcgtctcccctttgcacagtctccctctgatgccgagccgaggctggactgtactgccgccatctgggctcactgcagcctccctgcctgattctcctgcctcagcctgccgagtgcctgggattgcaggcgcgcgccgccacacctgactggttttcgtattttttggtggagacggggtttggccgtgttggccgggctggtctccagctcctgacggcgagtggtctgccagcctcggcctcccgaggtgccgggattgtagacggagtctcgctcactcagtgctcaatgttgcccaggctggagtgcagtggcgtgatctcggatcgctacaacctccacctcccagccgcctgccttggcctcctaaagtgccaagattgcagcctctgcccggccgccaccccgtataggaagtgaggagcgtctcggcctggccgcccatcgtctgggatgtgaggagcccctctgcctggccgcccagtctgggaagtgaggagcgcctcttcccggccgtcatcccgtctaggaggtgaggagcgtctctgcctggccgcccatcatctgggatgtggggagcgcctctgccccgccgccccgtctgagatataaagagtgcctctgcccggccgcgaccccgtctgggaactgaggagtgtctctgccccgccgccaccccgtctgggagtttgccagggtttggatacctgatccagaggaagtctggaagtcagcagagctgctcaaagattataagccaggagataaagtcctcctgcttcacctcgaggaaggaaaggtatag

SEQ ID NO: 15024 - DNA, 1257 bp, Artificial Sequence; identical to SEQ ID NO: 625
  Synthetic polypeptide

SEQ ID NO: 15025 - DNA, 1215 bp, Artificial Sequence; identical to SEQ ID NO: 626
  Synthetic polypeptide

SEQ ID NO: 15026 - DNA, 507 bp, Artificial Sequence; identical to SEQ ID NO: 628
  Synthetic polypeptide

SEQ ID NO: 15027 - DNA, 313 bp, Artificial Sequence; identical to SEQ ID NO: 629
  Synthetic polypeptide

SEQ ID NO: 15028 - DNA, 291 bp, Artificial Sequence; identical to SEQ ID NO: 630
  Synthetic polypeptide

SEQ ID NO: 15029 - DNA, 1522 bp, Artificial Sequence
  Synthetic polypeptide
tttcctggttccctgactgggaagtgaggtgattggtggatggtcgaggcagctccttaggtgacttaagcctgccctgtggaacattccggtgggggactctggccagcccgagcaacgtggatcctgagagcactcccaggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 15030 - DNA, 767 bp, Artificial Sequence
  Synthetic polypeptide
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgtaagtttcctaaggcctccccagccatgctgaattgaatcggggctgtctgtatggattggtgggcagctgcaccccctggagaatgtgccccccgccctggctgtgctgctcatcactgtggtcatcgccttcttcactgagtttgccagcaacacggcgaccatcatcatcttcctgccggtcctggcagagctggccatccgcctgagagtgcaccccctgtatctgatgattccgggcacagtcggctgctcctttgccttcatgctcccggtctcaacgccccccaactccatcgccttcgcctctggacacttgctggtcaaagacatggtgcggacaggcctcctgatgaacctgatgggtgtcctgctgctcagtttggctatgaatacctgggcacagaccatcttccagctgggcaccttcccggactgggctgatatgtactcggtcaatgtcacagcattgccacccaccttggccaatgacacatttcggaccctctga

SEQ ID NO: 15031 - DNA, 325 bp, Artificial Sequence
  Synthetic polypeptide
tgacatagtttggctgtgtccccacccaaatctcatcctgaattgtgtagttcccattatccccacatgtcatgggacctggtgggaagtaatttaatcgtgggggcggttacccttatgctgttcttgtgacaatgagtgagttctcaagagatctgatgattttttgtaaggggcttttcccccttctgctcggcacttcttgctgccaccatgtgaagaaggacgtgtttgcttccacttccaccatgattgtaagtttcctaaggcctccccagccatgctgaattgaatcggggctgtctgtatggattggtgggcagct

SEQ ID NO: 15032 - DNA, 1282 bp, Artificial Sequence
  Synthetic polypeptide
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctga

SEQ ID NO: 15033 - DNA, 1477 bp, Artificial Sequence
  Synthetic polypeptide
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctcttttcttgcctggagaagagggaggggagaggacaagggccctggctactcctggattcctacagtccttgtccagcctccaagacccacaagtcccttcctctgggaagcccccctggcctggaggtgcaccaggaagaagtggtctggggctggcactaagccatggcccagggaagactgggggacccactag

SEQ ID NO: 15034 - DNA, 1303 bp, Artificial Sequence
  Synthetic polypeptide
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatgagaaggtggagctcacggcactcaggtatgcgttcaccgtggtggccaacatcaccgtctacggcgccgcctggctcctgctgcacctgcagggctcgtcgcgggtggagcccacccaagacatcagcatcagcgaccagctggggggccaggacgtgcccgtgttccggaacctgtccctgctggtggtgggtgtcggcgccgtgttctcactgctattccacctgggcacccgggagaggcgccggccgcatgcggaggagccaggcgagcacacccccctgttggcccctgccacggcccagcccctgctgctctggaagcactggctccgggagccggctttctaccaggtgggcatactgtacatgaccaccaggctcatcgtgaacctgtcccagacctacatggccatgtacctcacctactcgctccacctgcccaagaagttcatcgcgaccattcccctggtgatgtacctcagcggcttcttgtcctccttcctcatgaagcccatcaacaagtgcattgggaggaacatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacgaacagcggagcgttcgtgtacggctccatgagcttcttggataaggtggccaatgggctggcagtcatggccatccagagcctgcacccttgcccctcagagctctgctgcagggcctgcgtgagcttttaccactgggcgatggtggctgtgacgggcggcgtgggcgtggccgctgccctgtgtctctgtagcctcctgctgtggccgacccgcctgcgacgctgggaccgtgatgcccggccctga

SEQ ID NO: 15035 - DNA, 345 bp, Artificial Sequence
  Synthetic polypeptide
ggtatggtggctcaagtctgtaatccgagcactttgggaggccgaggcaggaggatcacttgaggctaggagttcgacttcagcctggccaacgtggtgaaaccccatccctaccaaaaatacaaacattagctggatgtggtgggatgtggcggcaggcaccgtctgcgtcctgctgtccttccccttcatcttcagcccctgcctgggctgtggggcggccacgcccgagtgggctgccctcctctactacggcccgttcatcgtgatcttccagtttggctgggcctccacacagatctcccacctcagcctcatcccggagctcgtcaccaacgaccatga

SEQ ID NO: 15036 - DNA, 750 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 15037 - DNA, 408 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttggaaggcataaatgttggctga

SEQ ID NO: 15038 - DNA, 612 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaatattccccaggacagctcagacgcgatcgtgagcaaggccattgacttgtggcacaaacactgtgggaccccggtccattcaagctga

SEQ ID NO: 15039 - DNA, 549 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagaggcaaggtttgggataa

SEQ ID NO: 15040 - DNA, 663 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaagttatggcactgaacagtgcagagaagataacaaagtttctggaaaat

SEQ ID NO: 15041 - DNA, 616 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatcctagtttttgtagctgtcgaaattttattaacctttaaaataaaag

SEQ ID NO: 15042 - DNA, 570 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagagggtttgggataaagttgtgagtggatcctgtaagatc

SEQ ID NO: 15043 - DNA, 533 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgacgctttgtgaaccaattaaataccaagtaccgggattccttgccccagttgccaaaagcgtttgaacaatacttgaatctggaagatggcagactgctgactcatctgaggatgtgttccgcggcgcccaaacttccttatgatctctggttcaagaggtgctttgcgggatgtttgcctgaatccagtttacagag

SEQ ID NO: 15044 - DNA, 337 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgccatagctaaagccatggaggaaatggtggaagatagtgtcgactgttactggatcacccgac

SEQ ID NO: 15045 - DNA, 276 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatgatgaagtgtttcttgcc

SEQ ID NO: 15046 - DNA, 260 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggagccagatga

SEQ ID NO: 15047 - DNA, 444 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgttttgccttaaaaacttttggtggctccctgttgttattagaataaaagtgacacatctttacttggcattcatggccatgcacattctgacccaaccttcttactttttgtttttttaa

SEQ ID NO: 15048 - DNA, 325 bp, Artificial Sequence
  Synthetic polypeptide
gagaagaattcaatgggctgttggtggttctgagatgtaggggccaagtacaaagactagggaatcttgcctccacaccacgagtcccatgccaaggtgatgatgtatcgtaaggagcagtacttggatgtccttcatgccctgaaagtcgttcgctttgttagtgatgccacacctcaggctgaagtctatctccgcatgtatcagctggagtctgggaagttacctcgaagtccctcttttccactggttagtggtcacttttgtctgacactaagctcaactctagaccgtcccatcttgccggcctttgattacatcatgt

SEQ ID NO: 15049 - DNA, 666 bp, Artificial Sequence
  Synthetic polypeptide
ggctggacgcggtggctcgtgcctgtaatcccagcagtttgggaggctgaggcgggcggatcacctgagagggatggacaagctgtgctggagaatgtgtcagagggtggcaaggaacttcctggctgcctggggagacagcagaacccaggccacacgctggaagccggctggtttctgctccgtcattgcattcggaaaggcgaccccgaacttcgagcccacgtgattgacaagttcctattgttgcccttccactccggatgggaccctgaccacggaggcctcttttacttccaggatgctgataacttctgccccacccagctggagtgggccatgaagctctggtggccacacagtgaagccatgattgccttcctcatgggttacagtgacagtggggaccctgtgctgctgcgcctcttctaccaagtggctgagtacaccttccgccagtttcgcgatcccgagtacggggaatggtttggctacctgagccgagagggcaaggtggccctctccatcaagggaggtcctttcaaaggctgcttccacgtgccgcggtgcctagccatgtgcgaggagatgctgggcgccctgctgagccgccccgcccccgccccctcccccgcccccacccccgcctgccgaggcgcggaataa

SEQ ID NO: 15050 - DNA, 964 bp, Artificial Sequence
  Synthetic polypeptide
agaggagcaagagattaagagaaaaagatatttgaagaggtaatgacagaattgtcaatctttgcaaagacacatttacaatttcacaaaattcagtgaaaacacaggatgaaataaaggaaaacatgcctagacacatcataatcatagtgctgaaaactaaaaataaggaaaatgtctcaaaaacagtgagagaagagtgatacattacatgcaagggactatgatttgaatgactgcaaatttctgatcagaaatcctggaggcaagtagatagtggagcaccttctttaagtgctgaaagaaaagaacttttaagccagaattctctatccagcaaaataatccttcaggaataaaagcaaaaaagagagacattctcagatggaggaaatgactggaattcatttccagcagacctgctctataagacatgttaatggaatttctgcaggatgaagcaaaatgatactacagagaaattagatctttagggatgaagaacagcagaaatggtaaatagtaggcattggcacatctccacttaatagaatatgttggagaacaaactgctttgctaataaagatggtcccagaggagcagcgcctcatagccgccattgtcctggtggtgtgggtctcagccctggcgtcgtccctgattgacaacatcccgttcactgctaccatgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 15051 - DNA, 195 bp, Artificial Sequence
  Synthetic polypeptide
tatcttgtgttgtttcagagagcagaactgggattcttggttcagggaggcagatttccagtgattgtaaggaagaatttgtaacagtggagtgcactgccttgcaaaataagatggggacttgcttggggtcttgctgcccaggctggtcttgaactcgtggcgtcaagggatcctcctgtctcagcctcctaa

SEQ ID NO: 15052 - DNA, 605 bp, Artificial Sequence; identical to SEQ ID NO: 8066
  Synthetic polypeptide

SEQ ID NO: 15053 - DNA, 372 bp, Artificial Sequence; identical to SEQ ID NO: 8067
  Synthetic polypeptide

SEQ ID NO: 15054 - DNA, 422 bp, Artificial Sequence; identical to SEQ ID NO: 8068
  Synthetic polypeptide

SEQ ID NO: 15055 - DNA, 476 bp, Artificial Sequence; identical to SEQ ID NO: 8069
  Synthetic polypeptide

SEQ ID NO: 15056 - DNA, 1807 bp, Artificial Sequence; identical to SEQ ID NO: 8089
  Synthetic polypeptide

SEQ ID NO: 15057 - DNA, 404 bp, Artificial Sequence; identical to SEQ ID NO: 6813
  Synthetic polypeptide

SEQ ID NO: 15058 - DNA, 417 bp, Artificial Sequence; identical to SEQ ID NO: 6814
  Synthetic polypeptide

SEQ ID NO: 15059 - DNA, 485 bp, Artificial Sequence; identical to SEQ ID NO: 6815
  Synthetic polypeptide

SEQ ID NO: 15060 - DNA, 1745 bp, Artificial Sequence; identical to SEQ ID NO: 6816
  Synthetic polypeptide

SEQ ID NO: 15061 - DNA, 414 bp, Artificial Sequence; identical to SEQ ID NO: 6481
  Synthetic polypeptide

SEQ ID NO: 15062 - DNA, 1325 bp, Artificial Sequence; identical to SEQ ID NO: 7686
  Synthetic polypeptide

SEQ ID NO: 15063 - DNA, 1691 bp, Artificial Sequence; identical to SEQ ID NO: 7687
  Synthetic polypeptide

SEQ ID NO: 15064 - DNA, 1541 bp, Artificial Sequence; identical to SEQ ID NO: 7688
  Synthetic polypeptide

SEQ ID NO: 15065 - DNA, 374 bp, Artificial Sequence; identical to SEQ ID NO: 8117
  Synthetic polypeptide

SEQ ID NO: 15066 - DNA, 3021 bp, Artificial Sequence; identical to SEQ ID NO: 449
  Synthetic polypeptide

SEQ ID NO: 15067 - DNA, 3075 bp, Artificial Sequence; identical to SEQ ID NO: 450
  Synthetic polypeptide

SEQ ID NO: 15068 - DNA, 1143 bp, Artificial Sequence; identical to SEQ ID NO: 451
  Synthetic polypeptide

SEQ ID NO: 15069 - DNA, 1554 bp, Artificial Sequence; identical to SEQ ID NO: 8073
  Synthetic polypeptide

SEQ ID NO: 15070 - DNA, 1154 bp, Artificial Sequence; identical to SEQ ID NO: 8078
  Synthetic polypeptide

SEQ ID NO: 15071 - DNA, 163 bp, Artificial Sequence; identical to SEQ ID NO: 480
  Synthetic polypeptide

SEQ ID NO: 15072 - DNA, 104 bp, Artificial Sequence; identical to SEQ ID NO: 481
  Synthetic polypeptide

SEQ ID NO: 15073 - DNA, 1089 bp, Artificial Sequence; identical to SEQ ID NO: 8101
  Synthetic polypeptide

SEQ ID NO: 15074 - DNA, 534 bp, Artificial Sequence; identical to SEQ ID NO: 8079
  Synthetic polypeptide

SEQ ID NO: 15075 - DNA, 500 bp, Artificial Sequence; identical to SEQ ID NO: 8080
  Synthetic polypeptide

SEQ ID NO: 15076 - DNA, 453 bp, Artificial Sequence; identical to SEQ ID NO: 8081
  Synthetic polypeptide

SEQ ID NO: 15077 - DNA, 920 bp, Artificial Sequence; identical to SEQ ID NO: 8111
  Synthetic polypeptide

SEQ ID NO: 15078 - DNA, 1227 bp, Artificial Sequence; identical to SEQ ID NO: 7622
  Synthetic polypeptide

SEQ ID NO: 15079 - DNA, 1138 bp, Artificial Sequence; identical to SEQ ID NO: 7655
  Synthetic polypeptide

SEQ ID NO: 15080 - DNA, 427 bp, Artificial Sequence; identical to SEQ ID NO: 573
  Synthetic polypeptide

SEQ ID NO: 15081 - DNA, 1629 bp, Artificial Sequence; identical to SEQ ID NO: 8070
  Synthetic polypeptide

SEQ ID NO: 15082 - DNA, 1500 bp, Artificial Sequence; identical to SEQ ID NO: 8071
  Synthetic polypeptide

SEQ ID NO: 15083 - DNA, 186 bp, Artificial Sequence; identical to SEQ ID NO: 7638
  Synthetic polypeptide

SEQ ID NO: 15084 - DNA, 5196 bp, Artificial Sequence; identical to SEQ ID NO: 8162
  Synthetic polypeptide

SEQ ID NO: 15085 - DNA, 5277 bp, Artificial Sequence; identical to SEQ ID NO: 8163
  Synthetic polypeptide

SEQ ID NO: 15086 - DNA, 3933 bp, Artificial Sequence; identical to SEQ ID NO: 8164
  Synthetic polypeptide

SEQ ID NO: 15087 - DNA, 2010 bp, Artificial Sequence; identical to SEQ ID NO: 8165
  Synthetic polypeptide

SEQ ID NO: 15088 - DNA, 404 bp, Artificial Sequence; identical to SEQ ID NO: 7701
  Synthetic polypeptide

SEQ ID NO: 15089 - DNA, 336 bp, Artificial Sequence; identical to SEQ ID NO: 7702
  Synthetic polypeptide

SEQ ID NO: 15090 - DNA, 3325 bp, Artificial Sequence; identical to SEQ ID NO: 7703
  Synthetic polypeptide

SEQ ID NO: 15091 - DNA, 169 bp, Artificial Sequence; identical to SEQ ID NO: 7704
  Synthetic polypeptide

SEQ ID NO: 15092 - DNA, 169 bp, Artificial Sequence; identical to SEQ ID NO: 7705
  Synthetic polypeptide

SEQ ID NO: 15093 - DNA, 241 bp, Artificial Sequence; identical to SEQ ID NO: 7706
  Synthetic polypeptide

SEQ ID NO: 15094 - DNA, 273 bp, Artificial Sequence; identical to SEQ ID NO: 7707
  Synthetic polypeptide

SEQ ID NO: 15095 - DNA, 329 bp, Artificial Sequence; identical to SEQ ID NO: 7708
  Synthetic polypeptide

SEQ ID NO: 15096 - DNA, 203 bp, Artificial Sequence; identical to SEQ ID NO: 7709
  Synthetic polypeptide

SEQ ID NO: 15097 - DNA, 271 bp, Artificial Sequence; identical to SEQ ID NO: 7710
  Synthetic polypeptide

SEQ ID NO: 15098 - DNA, 297 bp, Artificial Sequence; identical to SEQ ID NO: 7711
  Synthetic polypeptide

SEQ ID NO: 15099 - DNA, 127 bp, Artificial Sequence; identical to SEQ ID NO: 7712
  Synthetic polypeptide

SEQ ID NO: 15100 - DNA, 2254 bp, Artificial Sequence; identical to SEQ ID NO: 8053
  Synthetic polypeptide

SEQ ID NO: 15101 - DNA, 2044 bp, Artificial Sequence; identical to SEQ ID NO: 8054
  Synthetic polypeptide

SEQ ID NO: 15102 - DNA, 1735 bp, Artificial Sequence; identical to SEQ ID NO: 8055
  Synthetic polypeptide

SEQ ID NO: 15103 - DNA, 1089 bp, Artificial Sequence; identical to SEQ ID NO: 8115
  Synthetic polypeptide

SEQ ID NO: 15104 - DNA, 201 bp, Artificial Sequence; identical to SEQ ID NO: 6463
  Synthetic polypeptide

SEQ ID NO: 15105 - DNA, 159 bp, Artificial Sequence; identical to SEQ ID NO: 6464
  Synthetic polypeptide

SEQ ID NO: 15106 - DNA, 171 bp, Artificial Sequence; identical to SEQ ID NO: 6873
  Synthetic polypeptide

SEQ ID NO: 15107 - DNA, 633 bp, Artificial Sequence; identical to SEQ ID NO: 6874
  Synthetic polypeptide

SEQ ID NO: 15108 - DNA, 636 bp, Artificial Sequence; identical to SEQ ID NO: 6875
  Synthetic polypeptide

SEQ ID NO: 15109 - DNA, 480 bp, Artificial Sequence; identical to SEQ ID NO: 6876
  Synthetic polypeptide

SEQ ID NO: 15110 - DNA, 192 bp, Artificial Sequence; identical to SEQ ID NO: 8269
  Synthetic polypeptide

SEQ ID NO: 15111 - DNA, 100 bp, Artificial Sequence; identical to SEQ ID NO: 8330
  Synthetic polypeptide

SEQ ID NO: 15112 - DNA, 337 bp, Artificial Sequence; identical to SEQ ID NO: 6393
  Synthetic polypeptide

SEQ ID NO: 15113 - DNA, 795 bp, Artificial Sequence; identical to SEQ ID NO: 8525
  Synthetic polypeptide

SEQ ID NO: 15114 - DNA, 194 bp, Artificial Sequence; identical to SEQ ID NO: 8526
  Synthetic polypeptide

SEQ ID NO: 15115 - DNA, 462 bp, Artificial Sequence; identical to SEQ ID NO: 8527
  Synthetic polypeptide

SEQ ID NO: 15116 - DNA, 66 bp, Artificial Sequence; identical to SEQ ID NO: 8528
  Synthetic polypeptide

SEQ ID NO: 15117 - DNA, 268 bp, Artificial Sequence; identical to SEQ ID NO: 8529
  Synthetic polypeptide

SEQ ID NO: 15118 - DNA, 132 bp, Artificial Sequence; identical to SEQ ID NO: 8530
  Synthetic polypeptide

SEQ ID NO: 15119 - DNA, 295 bp, Artificial Sequence; identical to SEQ ID NO: 8323
  Synthetic polypeptide

SEQ ID NO: 15120 - DNA, 1117 bp, Artificial Sequence; identical to SEQ ID NO: 8324
  Synthetic polypeptide

SEQ ID NO: 15121 - DNA, 931 bp, Artificial Sequence; identical to SEQ ID NO: 8325
  Synthetic polypeptide

SEQ ID NO: 15122 - DNA, 873 bp, Artificial Sequence; identical to SEQ ID NO: 8120
  Synthetic polypeptide

SEQ ID NO: 15123 - DNA, 921 bp, Artificial Sequence; identical to SEQ ID NO: 8121
  Synthetic polypeptide

SEQ ID NO: 15124 - DNA, 507 bp, Artificial Sequence; identical to SEQ ID NO: 8229
  Synthetic polypeptide

SEQ ID NO: 15125 - DNA, 1185 bp, Artificial Sequence; identical to SEQ ID NO: 8800
  Synthetic polypeptide

SEQ ID NO: 15126 - DNA, 550 bp, Artificial Sequence; identical to SEQ ID NO: 8801
  Synthetic polypeptide

SEQ ID NO: 15127 - DNA, 387 bp, Artificial Sequence; identical to SEQ ID NO: 8802
  Synthetic polypeptide

SEQ ID NO: 15128 - DNA, 1713 bp, Artificial Sequence; identical to SEQ ID NO: 8803
  Synthetic polypeptide

SEQ ID NO: 15129 - DNA, 1950 bp, Artificial Sequence; identical to SEQ ID NO: 8804
  Synthetic polypeptide

SEQ ID NO: 15130 - DNA, 1005 bp, Artificial Sequence; identical to SEQ ID NO: 8447
  Synthetic polypeptide

SEQ ID NO: 15131 - DNA, 942 bp, Artificial Sequence; identical to SEQ ID NO: 8448
  Synthetic polypeptide

SEQ ID NO: 15132 - DNA, 559 bp, Artificial Sequence; identical to SEQ ID NO: 8449
  Synthetic polypeptide

SEQ ID NO: 15133 - DNA, 2405 bp, Artificial Sequence; identical to SEQ ID NO: 8354
  Synthetic polypeptide

SEQ ID NO: 15134 - DNA, 2252 bp, Artificial Sequence; identical to SEQ ID NO: 8355
  Synthetic polypeptide

SEQ ID NO: 15135 - DNA, 2240 bp, Artificial Sequence; identical to SEQ ID NO: 8356
  Synthetic polypeptide

SEQ ID NO: 15136 - DNA, 820 bp, Artificial Sequence; identical to SEQ ID NO: 7641
  Synthetic polypeptide

SEQ ID NO: 15137 - DNA, 946 bp, Artificial Sequence; identical to SEQ ID NO: 7642
  Synthetic polypeptide

SEQ ID NO: 15138 - DNA, 583 bp, Artificial Sequence; identical to SEQ ID NO: 7840
  Synthetic polypeptide

SEQ ID NO: 15139 - DNA, 742 bp, Artificial Sequence; identical to SEQ ID NO: 6357
  Synthetic polypeptide

SEQ ID NO: 15140 - DNA, 590 bp, Artificial Sequence; identical to SEQ ID NO: 6358
  Synthetic polypeptide

SEQ ID NO: 15141 - DNA, 577 bp, Artificial Sequence; identical to SEQ ID NO: 6359
  Synthetic polypeptide

SEQ ID NO: 15142 - DNA, 430 bp, Artificial Sequence; identical to SEQ ID NO: 6360
  Synthetic polypeptide

SEQ ID NO: 15143 - DNA, 670 bp, Artificial Sequence; identical to SEQ ID NO: 6361
  Synthetic polypeptide

SEQ ID NO: 15144 - DNA, 366 bp, Artificial Sequence; identical to SEQ ID NO: 7663
  Synthetic polypeptide

SEQ ID NO: 15145 - DNA, 543 bp, Artificial Sequence; identical to SEQ ID NO: 6496
  Synthetic polypeptide

SEQ ID NO: 15146 - DNA, 378 bp, Artificial Sequence; identical to SEQ ID NO: 6497
  Synthetic polypeptide

SEQ ID NO: 15147 - DNA, 267 bp, Artificial Sequence; identical to SEQ ID NO: 6498
  Synthetic polypeptide

SEQ ID NO: 15148 - DNA, 416 bp, Artificial Sequence; identical to SEQ ID NO: 6499
  Synthetic polypeptide

SEQ ID NO: 15149 - DNA, 162 bp, Artificial Sequence; identical to SEQ ID NO: 6500
  Synthetic polypeptide

SEQ ID NO: 15150 - DNA, 336 bp, Artificial Sequence; identical to SEQ ID NO: 7520
  Synthetic polypeptide

SEQ ID NO: 15151 - DNA, 346 bp, Artificial Sequence; identical to SEQ ID NO: 7521
  Synthetic polypeptide

SEQ ID NO: 15152 - DNA, 272 bp, Artificial Sequence; identical to SEQ ID NO: 8166
  Synthetic polypeptide

SEQ ID NO: 15153 - DNA, 89 bp, Artificial Sequence; identical to SEQ ID NO: 8167
  Synthetic polypeptide

SEQ ID NO: 15154 - DNA, 223 bp, Artificial Sequence; identical to SEQ ID NO: 8168
  Synthetic polypeptide

SEQ ID NO: 15155 - DNA, 207 bp, Artificial Sequence; identical to SEQ ID NO: 7693
  Synthetic polypeptide

SEQ ID NO: 15156 - DNA, 268 bp, Artificial Sequence; identical to SEQ ID NO: 7694
  Synthetic polypeptide

SEQ ID NO: 15157 - DNA, 483 bp, Artificial Sequence; identical to SEQ ID NO: 7323
  Synthetic polypeptide

SEQ ID NO: 15158 - DNA, 252 bp, Artificial Sequence; identical to SEQ ID NO: 8153
  Synthetic polypeptide

SEQ ID NO: 15159 - DNA, 1216 bp, Artificial Sequence; identical to SEQ ID NO: 6819
  Synthetic polypeptide

SEQ ID NO: 15160 - DNA, 510 bp, Artificial Sequence; identical to SEQ ID NO: 6820
  Synthetic polypeptide

SEQ ID NO: 15161 - DNA, 1086 bp, Artificial Sequence; identical to SEQ ID NO: 6423
  Synthetic polypeptide

SEQ ID NO: 15162 - DNA, 139 bp, Artificial Sequence; identical to SEQ ID NO: 8939
  Synthetic polypeptide

SEQ ID NO: 15163 - DNA, 368 bp, Artificial Sequence; identical to SEQ ID NO: 8940
  Synthetic polypeptide

SEQ ID NO: 15164 - DNA, 2192 bp, Artificial Sequence; identical to SEQ ID NO: 8941
  Synthetic polypeptide

SEQ ID NO: 15165 - DNA, 1328 bp, Artificial Sequence; identical to SEQ ID NO: 8942
  Synthetic polypeptide

SEQ ID NO: 15166 - DNA, 2117 bp, Artificial Sequence; identical to SEQ ID NO: 8943
  Synthetic polypeptide

SEQ ID NO: 15167 - DNA, 1265 bp, Artificial Sequence; identical to SEQ ID NO: 8944
  Synthetic polypeptide

SEQ ID NO: 15168 - DNA, 1331 bp, Artificial Sequence; identical to SEQ ID NO: 8945
  Synthetic polypeptide

SEQ ID NO: 15169 - DNA, 320 bp, Artificial Sequence; identical to SEQ ID NO: 8218
  Synthetic polypeptide

SEQ ID NO: 15170 - DNA, 485 bp, Artificial Sequence; identical to SEQ ID NO: 8219
  Synthetic polypeptide

SEQ ID NO: 15171 - DNA, 326 bp, Artificial Sequence; identical to SEQ ID NO: 6484
  Synthetic polypeptide

SEQ ID NO: 15172 - DNA, 146 bp, Artificial Sequence; identical to SEQ ID NO: 6485
  Synthetic polypeptide

SEQ ID NO: 15173 - DNA, 3238 bp, Artificial Sequence; identical to SEQ ID NO: 8118
  Synthetic polypeptide

SEQ ID NO: 15174 - DNA, 4233 bp, Artificial Sequence; identical to SEQ ID NO: 8337
  Synthetic polypeptide

SEQ ID NO: 15175 - DNA, 2022 bp, Artificial Sequence; identical to SEQ ID NO: 8338
  Synthetic polypeptide

SEQ ID NO: 15176 - DNA, 636 bp, Artificial Sequence; identical to SEQ ID NO: 8339
  Synthetic polypeptide

SEQ ID NO: 15177 - DNA, 1746 bp, Artificial Sequence; identical to SEQ ID NO: 8226
  Synthetic polypeptide

SEQ ID NO: 15178 - DNA, 1749 bp, Artificial Sequence; identical to SEQ ID NO: 8227
  Synthetic polypeptide

SEQ ID NO: 15179 - DNA, 519 bp, Artificial Sequence; identical to SEQ ID NO: 8228
  Synthetic polypeptide

SEQ ID NO: 15180 - DNA, 3609 bp, Artificial Sequence; identical to SEQ ID NO: 11178
  Synthetic polypeptide

SEQ ID NO: 15181 - DNA, 283 bp, Artificial Sequence; identical to SEQ ID NO: 11179
  Synthetic polypeptide

SEQ ID NO: 15182 - DNA, 1461 bp, Artificial Sequence; identical to SEQ ID NO: 7696
  Synthetic polypeptide

SEQ ID NO: 15183 - DNA, 2582 bp, Artificial Sequence; identical to SEQ ID NO: 12600
  Synthetic polypeptide

SEQ ID NO: 15184 - DNA, 353 bp, Artificial Sequence; identical to SEQ ID NO: 12601
  Synthetic polypeptide

SEQ ID NO: 15185 - DNA, 142 bp, Artificial Sequence; identical to SEQ ID NO: 12602
  Synthetic polypeptide

SEQ ID NO: 15186 - DNA, 66 bp, Artificial Sequence; identical to SEQ ID NO: 12603
  Synthetic polypeptide

SEQ ID NO: 15187 - DNA, 1224 bp, Artificial Sequence; identical to SEQ ID NO: 6690
  Synthetic polypeptide

SEQ ID NO: 15188 - DNA, 355 bp, Artificial Sequence; identical to SEQ ID NO: 8468
  Synthetic polypeptide

SEQ ID NO: 15189 - DNA, 192 bp, Artificial Sequence; identical to SEQ ID NO: 12734
  Synthetic polypeptide

SEQ ID NO: 15190 - DNA, 1965 bp, Artificial Sequence; identical to SEQ ID NO: 8289
  Synthetic polypeptide

SEQ ID NO: 15191 - DNA, 853 bp, Artificial Sequence; identical to SEQ ID NO: 8074
  Synthetic polypeptide

SEQ ID NO: 15192 - DNA, 353 bp, Artificial Sequence; identical to SEQ ID NO: 8295
  Synthetic polypeptide

SEQ ID NO: 15193 - DNA, 483 bp, Artificial Sequence; identical to SEQ ID NO: 7330
  Synthetic polypeptide

SEQ ID NO: 15194 - DNA, 163 bp, Artificial Sequence; identical to SEQ ID NO: 8321
  Synthetic polypeptide

SEQ ID NO: 15195 - DNA, 681 bp, Artificial Sequence; identical to SEQ ID NO: 8322
  Synthetic polypeptide

SEQ ID NO: 15196 - DNA, 340 bp, Artificial Sequence; identical to SEQ ID NO: 8193
  Synthetic polypeptide

SEQ ID NO: 15197 - DNA, 2147 bp, Artificial Sequence; identical to SEQ ID NO: 8253
  Synthetic polypeptide

SEQ ID NO: 15198 - DNA, 643 bp, Artificial Sequence; identical to SEQ ID NO: 8156
  Synthetic polypeptide

SEQ ID NO: 15199 - DNA, 589 bp, Artificial Sequence; identical to SEQ ID NO: 8157
  Synthetic polypeptide

SEQ ID NO: 15200 - DNA, 301 bp, Artificial Sequence; identical to SEQ ID NO: 8158
  Synthetic polypeptide

SEQ ID NO: 15201 - DNA, 2729 bp, Artificial Sequence
  Synthetic polypeptide
gccaggagtccccggcgtgcagtggagcctcgctgggggaaatgacagcttggaccatgggcgcccgcggtctggacaagcgaggaagtttctttaagctcattgacacaattgcctcggagatcggagaactgaaacaggagatggtgcggacagatgtcaacctggaaaatggcctggaacccgctgaaacccacagcatggtaagacacaaggatggtggctattccgaggaagaggacgtgaagacctgtgcccgggactcaggctatgacagcctctccaacaggctcagcatcttggaccggctcctccacacccaccccatatggctgcagctgagtctgagtgaggaggaggcagcagaggtcctgcaggcccagcctccggggatcttcctggttcataaatctaccaagatgcagaagaaagtcctctccctccgcctgccctgtgaatttggggccccactcaaggaatttgccataaaggaaagcacatacaccttttccctggaaggctcaggaatcagtttcgcagatttattccggctcattgctttctactgcatcagcagggatgttctaccatttaccttgaagttgccttatgccatttcaacagccaagtcggaggctcagcttgaagaactggcccagatgggactaaatttctggagctccccagctgacagcaaacccccgaaccttccacctccccataggcctctttcctccgacggtgtctgtcctgcctccctgcgtcagctctgccttataaatggagtgcattctatcaaaaccaggacgccttcagagctggagtgcagccagaccaacggggccctgtgctttattaatccccttttcttgaaagtgcacagccaggacctcagtggaggcctgaaacggccgagcacaaggactcccaacgcgaatggcacggagcggactcggtcccccccacccaggcccccgccacccgctattaatagtctccacacaagccctcggctggccaggactgaaacccagacgagcatgccagaaacagtcaaccataacaaacatgggaacgtagctctgcctggaacgaaaccaactcccatccctccaccccggctgaagaagcaggcttcttttctggaagcagagggcggtgcaaagaccttgagcggcggccggccgggcgcaggcccggagctggagctgggcacagctggcagcccaggtggggccccgcctgaggccgccccgggggattgcacaagggccccgccgcccagctctgaatcacggcccccgtgccatggaggccggcagcggctgagcgacatgagcatttctacttcctcctccgactcgctggagttcgaccggagcatgcctctgtttggctacgaggcggacaccaacagcagcctggaggactacgagggggaaagtgaccaagagaccatggcgccccccatcaagtccaaaaagaaaaggagcagctccttcgtgctgcccaagctcgtcaagtcccagctgcagaaggtgagcggggtgttcagctccttcatgaccccggagaagcggatggtccgcaggatcgccgagctttcccgggacaaatgcacctacttcgggtgcttagtgcaggactacgtgagcttcctgcaggagaacaaggagtgccacgtgtccagcaccgacatgctgcagaccatccggcagttcatgacccaggtcaagaactatttgtctcagagctcggagctggacccccccatcgagtcgctgatccctgaagaccaaatagatgtggtgctggaaaaagccatgcacaagtgcatcttgaagcccctcaaggggcacgtggaggccatgctgaaggactttcacatggccgatggctcatggaagcaactcaaggagaacctgcagcttgtgcggcagaggaatccgcaggagctgggggtcttcgccccgacccctgattttgtggatgtggagaaaatcaaagtcaagttcatgaccatgcagaagatgtattcgccggaaaagaaggtcatgctgctgctgcgggtctgcaagctcatttacacggtcatggagaacaactcagggaggatgtatggcgctgatgacttcttgccagtcctgacctatgtcatagcccagtgtgacatgcttgaattggacactgaaatcgagtacatgatggagctcctagacccatcgctgttacatggagaaggaggctattacttgacaagcgcatatggagcactttctctgataaagaatttccaagaagaacaagcagcgcgactgctcagctcagaaaccagagacaccctgaggcagtggcacaaacggagaaccaccaaccggaccatcccctctgtggacgacttccagaattacctccgagttgcatttcaggaggtcaacagtggttgcacaggaaagaccctccttgtgagaccttacatcaccactgaggatgtgtgtcagatctgcgctgagaagttcaaggtgggggaccctgaggagtacagcctctttctcttcgttgacgagacatggcagcagctggcagaggacacttaccctcaaaaaatcaaggcggagctgcacagccgaccacagccccacatcttccactttgtctacaaacgcatcaagaacgatccttatggcatcattttccagaacggggaagaagacctcaccacctcctag

SEQ ID NO: 15202 - DNA, 558 bp, Artificial Sequence; identical to SEQ ID NO: 8182
  Synthetic polypeptide

SEQ ID NO: 15203 - DNA, 1793 bp, Artificial Sequence; identical to SEQ ID NO: 8183
  Synthetic polypeptide

SEQ ID NO: 15204 - DNA, 1931 bp, Artificial Sequence; identical to SEQ ID NO: 8184
  Synthetic polypeptide

SEQ ID NO: 15205 - DNA, 227 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcaggg

SEQ ID NO: 15206 - DNA, 1622 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 15207 - DNA, 291 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagct

SEQ ID NO: 15208 - DNA, 1415 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 15209 - DNA, 364 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaacc

SEQ ID NO: 15210 - DNA, 509 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagc

SEQ ID NO: 15211 - DNA, 526 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactg

SEQ ID NO: 15212 - DNA, 742 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 15213 - DNA, 408 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgc

SEQ ID NO: 15214 - DNA, 466 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaa

SEQ ID NO: 15215 - DNA, 674 bp, Artificial Sequence
  Synthetic polypeptide
gcagtgactcacgcctgtagtcccagcacttcggaaggcgaaggtgggcagatcacttgaggccaggagttcgagaccagcctgggaaacatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggcc

SEQ ID NO: 15216 - DNA, 289 bp, Artificial Sequence; identical to SEQ ID NO: 7343
  Synthetic polypeptide

SEQ ID NO: 15217 - DNA, 246 bp, Artificial Sequence; identical to SEQ ID NO: 7344
  Synthetic polypeptide

SEQ ID NO: 15218 - DNA, 149 bp, Artificial Sequence; identical to SEQ ID NO: 7345
  Synthetic polypeptide

SEQ ID NO: 15219 - DNA, 89 bp, Artificial Sequence; identical to SEQ ID NO: 7346
  Synthetic polypeptide

SEQ ID NO: 15220 - DNA, 80 bp, Artificial Sequence; identical to SEQ ID NO: 7347
  Synthetic polypeptide

SEQ ID NO: 15221 - DNA, 527 bp, Artificial Sequence; identical to SEQ ID NO: 7665
  Synthetic polypeptide

SEQ ID NO: 15222 - DNA, 2983 bp, Artificial Sequence; identical to SEQ ID NO: 8169
  Synthetic polypeptide

SEQ ID NO: 15223 - DNA, 3010 bp, Artificial Sequence; identical to SEQ ID NO: 8170
  Synthetic polypeptide

SEQ ID NO: 15224 - DNA, 333 bp, Artificial Sequence; identical to SEQ ID NO: 6583
  Synthetic polypeptide

SEQ ID NO: 15225 - DNA, 1775 bp, Artificial Sequence; identical to SEQ ID NO: 568
  Synthetic polypeptide

SEQ ID NO: 15226 - DNA, 1477 bp, Artificial Sequence; identical to SEQ ID NO: 509
  Synthetic polypeptide

SEQ ID NO: 15227 - DNA, 1369 bp, Artificial Sequence; identical to SEQ ID NO: 510
  Synthetic polypeptide

SEQ ID NO: 15228 - DNA, 709 bp, Artificial Sequence; identical to SEQ ID NO: 511
  Synthetic polypeptide

SEQ ID NO: 15229 - DNA, 303 bp, Artificial Sequence; identical to SEQ ID NO: 6723
  Synthetic polypeptide

SEQ ID NO: 15230 - DNA, 189 bp, Artificial Sequence; identical to SEQ ID NO: 6724
  Synthetic polypeptide

SEQ ID NO: 15231 - DNA, 318 bp, Artificial Sequence; identical to SEQ ID NO: 6725
  Synthetic polypeptide

SEQ ID NO: 15232 - DNA, 138 bp, Artificial Sequence; identical to SEQ ID NO: 6726
  Synthetic polypeptide

SEQ ID NO: 15233 - DNA, 1306 bp, Artificial Sequence; identical to SEQ ID NO: 8428
  Synthetic polypeptide

SEQ ID NO: 15234 - DNA, 641 bp, Artificial Sequence; identical to SEQ ID NO: 8429
  Synthetic polypeptide

SEQ ID NO: 15235 - DNA, 1207 bp, Artificial Sequence; identical to SEQ ID NO: 8430
  Synthetic polypeptide

SEQ ID NO: 15236 - DNA, 1402 bp, Artificial Sequence; identical to SEQ ID NO: 8431
  Synthetic polypeptide

SEQ ID NO: 15237 - DNA, 2850 bp, Artificial Sequence; identical to SEQ ID NO: 512
  Synthetic polypeptide

SEQ ID NO: 15238 - DNA, 477 bp, Artificial Sequence; identical to SEQ ID NO: 513
  Synthetic polypeptide

SEQ ID NO: 15239 - DNA, 4686 bp, Artificial Sequence; identical to SEQ ID NO: 8201
  Synthetic polypeptide

SEQ ID NO: 15240 - DNA, 6266 bp, Artificial Sequence; identical to SEQ ID NO: 8202
  Synthetic polypeptide

SEQ ID NO: 15241 - DNA, 5837 bp, Artificial Sequence; identical to SEQ ID NO: 8203
  Synthetic polypeptide

SEQ ID NO: 15242 - DNA, 3243 bp, Artificial Sequence; identical to SEQ ID NO: 12893
  Synthetic polypeptide

SEQ ID NO: 15243 - DNA, 878 bp, Artificial Sequence; identical to SEQ ID NO: 12894
  Synthetic polypeptide

SEQ ID NO: 15244 - DNA, 545 bp, Artificial Sequence; identical to SEQ ID NO: 12895
  Synthetic polypeptide

SEQ ID NO: 15245 - DNA, 877 bp, Artificial Sequence; identical to SEQ ID NO: 12896
  Synthetic polypeptide

SEQ ID NO: 15246 - DNA, 498 bp, Artificial Sequence; identical to SEQ ID NO: 12897
  Synthetic polypeptide

SEQ ID NO: 15247 - DNA, 615 bp, Artificial Sequence; identical to SEQ ID NO: 12898
  Synthetic polypeptide

SEQ ID NO: 15248 - DNA, 701 bp, Artificial Sequence; identical to SEQ ID NO: 658
  Synthetic polypeptide

SEQ ID NO: 15249 - DNA, 685 bp, Artificial Sequence
  Synthetic polypeptide
agcctggattgcagaatcaagaggccaggcttctactaacatctctgtgaaagtccagctagtatgacctgagatatattctttgtggtgcctgggcctcagtttctctactggtaaaatgcaggctctctctgtaacacctgagccatctaaaaaggaatggaactgcaagaagactacggatatgatactcaatgagattaagcaggggaaattccacaaccccatgtccattgctcaaatcctcccttccctgaaaggcaagacatacctagatgtgccccaggtcacttgtagtcctgatcatgaggtacaaccaactctacccagcaaccctggccctggccccacctctgcatctaacatcactgtcatatacaccataaataaccagctgaggggggttgagctgctcttcaacgagaccatcaatgttagtgtgaaaagtgggtcagtgttacttgttgtcctagaggaagcacagcgcaaaaatcctatgttcaaatttgaaaccacaatgacatcttggggccttgtcgtctcttctatcaacaatatcgcggaaaatgttaatcacaagacatactggcagtttcttagtggtgtaacacctttgaatgaaggggttgctgactacatacccttcaaccacgagcacatcacagccaatttcacacagtactaa

SEQ ID NO: 15250 - DNA, 298 bp, Artificial Sequence; identical to SEQ ID NO: 13442
  Synthetic polypeptide

SEQ ID NO: 15251 - DNA, 531 bp, Artificial Sequence
  Synthetic polypeptide
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 15252 - DNA, 1872 bp, Artificial Sequence
  Synthetic polypeptide
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtag

SEQ ID NO: 15253 - DNA, 544 bp, Artificial Sequence
  Synthetic polypeptide
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 15254 - DNA, 612 bp, Artificial Sequence
  Synthetic polypeptide
ggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 15255 - DNA, 1473 bp, Artificial Sequence; identical to SEQ ID NO: 12916
  Synthetic polypeptide

SEQ ID NO: 15256 - DNA, 1446 bp, Artificial Sequence; identical to SEQ ID NO: 12917
  Synthetic polypeptide

SEQ ID NO: 15257 - DNA, 1181 bp, Artificial Sequence; identical to SEQ ID NO: 12918
  Synthetic polypeptide

SEQ ID NO: 15258 - DNA, 921 bp, Artificial Sequence; identical to SEQ ID NO: 12919
  Synthetic polypeptide

SEQ ID NO: 15259 - DNA, 360 bp, Artificial Sequence; identical to SEQ ID NO: 12920
  Synthetic polypeptide

SEQ ID NO: 15260 - DNA, 366 bp, Artificial Sequence; identical to SEQ ID NO: 12921
  Synthetic polypeptide

SEQ ID NO: 15261 - DNA, 715 bp, Artificial Sequence; identical to SEQ ID NO: 12922
  Synthetic polypeptide

SEQ ID NO: 15262 - DNA, 671 bp, Artificial Sequence; identical to SEQ ID NO: 12923
  Synthetic polypeptide

SEQ ID NO: 15263 - DNA, 363 bp, Artificial Sequence; identical to SEQ ID NO: 12924
  Synthetic polypeptide

SEQ ID NO: 15264 - DNA, 339 bp, Artificial Sequence; identical to SEQ ID NO: 12925
  Synthetic polypeptide

SEQ ID NO: 15265 - DNA, 354 bp, Artificial Sequence; identical to SEQ ID NO: 12926
  Synthetic polypeptide

SEQ ID NO: 15266 - DNA, 494 bp, Artificial Sequence; identical to SEQ ID NO: 12927
  Synthetic polypeptide

SEQ ID NO: 15267 - DNA, 488 bp, Artificial Sequence; identical to SEQ ID NO: 12928
  Synthetic polypeptide

SEQ ID NO: 15268 - DNA, 472 bp, Artificial Sequence; identical to SEQ ID NO: 12929
  Synthetic polypeptide

SEQ ID NO: 15269 - DNA, 363 bp, Artificial Sequence; identical to SEQ ID NO: 12930
  Synthetic polypeptide

SEQ ID NO: 15270 - DNA, 3621 bp, Artificial Sequence; identical to SEQ ID NO: 8171
  Synthetic polypeptide

SEQ ID NO: 15271 - DNA, 3312 bp, Artificial Sequence; identical to SEQ ID NO: 8172
  Synthetic polypeptide

SEQ ID NO: 15272 - DNA, 2928 bp, Artificial Sequence; identical to SEQ ID NO: 8173
  Synthetic polypeptide

SEQ ID NO: 15273 - DNA, 3435 bp, Artificial Sequence; identical to SEQ ID NO: 8174
  Synthetic polypeptide

SEQ ID NO: 15274 - DNA, 4198 bp, Artificial Sequence
  Synthetic polypeptide
gcgtcatggataagcagacgggctatggagtttgaacccaggttgtctgggtccaaaacctggcccagccacttgctagctgtgtgacctaatccctctgcacctcaacctcctcatctataaaaacaaagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaa

SEQ ID NO: 15275 - DNA, 658 bp, Artificial Sequence; identical to SEQ ID NO: 7189
  Synthetic polypeptide

SEQ ID NO: 15276 - DNA, 1999 bp, Artificial Sequence; identical to SEQ ID NO: 7190
  Synthetic polypeptide

SEQ ID NO: 15277 - DNA, 671 bp, Artificial Sequence; identical to SEQ ID NO: 7191
  Synthetic polypeptide

SEQ ID NO: 15278 - DNA, 739 bp, Artificial Sequence; identical to SEQ ID NO: 7192
  Synthetic polypeptide

SEQ ID NO: 15279 - DNA, 352 bp, Artificial Sequence; identical to SEQ ID NO: 8547
  Synthetic polypeptide

SEQ ID NO: 15280 - DNA, 274 bp, Artificial Sequence; identical to SEQ ID NO: 8548
  Synthetic polypeptide

SEQ ID NO: 15281 - DNA, 246 bp, Artificial Sequence; identical to SEQ ID NO: 8549
  Synthetic polypeptide

SEQ ID NO: 15282 - DNA, 423 bp, Artificial Sequence; identical to SEQ ID NO: 6550
  Synthetic polypeptide

SEQ ID NO: 15283 - DNA, 950 bp, Artificial Sequence; identical to SEQ ID NO: 8419
  Synthetic polypeptide

SEQ ID NO: 15284 - DNA, 1562 bp, Artificial Sequence
  Synthetic polypeptide
tgacatgatttgcctctgtgtccccacccaaatctcatgatgaattgtaatccccacatgtcaggggagggacctggtgggaagtgattggatcatgggggaggatttccccctttctgttcttgtgatagtgagttatcacgagatctgatggtttaaaagtgtggcactttcccctttgcgctctttctttctctcctgccaccttgtgaagaaggtgcttgcttctcctttgccttctgccatgattttaagtttcccgaggcctccccagccatgtggaactatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 15285 - DNA, 1376 bp, Artificial Sequence
  Synthetic polypeptide
tgacatgatttgcctctgtgtccccacccaaatctcatgatgaattgtaatccccacatgtcaggggagggacctggtgggaagtgattggatcatgggggaggatttccccctttctgttcttgtgatagtgagttatcacgagatctgatggtttaaaagtgtggcactttcccctttgcgctctttctttctctcctgccaccttgtgaagaaggtgcttgcttctcctttgccttctgccatgattttaagtttcccgaggcctccccagccatgtggaactatttcctccttcttcacccctgaaaccatatccaaagaagcccccaaaccaaaaggatgttattaaatttccagaatggaatgatctcccaccaggcacttcacaagagaacatcccagtgaggccagttgtgatgaattctgagatgtggtacaagcgtcacagtattgcaattggagaggtgccagcttgccgtcttgtccaccgcagacagctgacagaggccaatgtagaagagatatggaagtctatgacattatcatacttacagaaaattcttggcctggattccttagaagaagttttagacgtcaaacttgtcaattcgaagttcatcatccataatgtatatagtgttagcaagcagggagttgttattcttgatgacaagtcaaaagaacttcctcattgggtgctgtcagctatgaagtgtttggcaaattggcccaactgttctgatttgaagcagcctatgtacttgggatttgaaaaagatgtctttaaaaccatagctgattactatggtcacttgaaagagcctctacttacatttcatctttttgatgcttttgtcagtgtactgggtttgttacagaaggagaaagtggcagttgaagcatttcagatttgctgccttctcctacctcctgaaaataggagaaagttacagctattgatgaggatgatggcaaggatttgcttaaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaa

SEQ ID NO: 15286 - DNA, 2662 bp, Artificial Sequence; identical to SEQ ID NO: 8473
  Synthetic polypeptide

SEQ ID NO: 15287 - DNA, 1822 bp, Artificial Sequence; identical to SEQ ID NO: 8474
  Synthetic polypeptide

SEQ ID NO: 15288 - DNA, 1461 bp, Artificial Sequence; identical to SEQ ID NO: 14755
  Synthetic polypeptide

SEQ ID NO: 15289 - DNA, 2502 bp, Artificial Sequence; identical to SEQ ID NO: 13060
  Synthetic polypeptide

SEQ ID NO: 15290 - DNA, 390 bp, Artificial Sequence; identical to SEQ ID NO: 13061
  Synthetic polypeptide

SEQ ID NO: 15291 - DNA, 771 bp, Artificial Sequence; identical to SEQ ID NO: 13062
  Synthetic polypeptide

SEQ ID NO: 15292 - DNA, 682 bp, Artificial Sequence; identical to SEQ ID NO: 9078
  Synthetic polypeptide

SEQ ID NO: 15293 - DNA, 78 bp, Artificial Sequence; identical to SEQ ID NO: 9079
  Synthetic polypeptide

SEQ ID NO: 15294 - DNA, 481 bp, Artificial Sequence; identical to SEQ ID NO: 9080
  Synthetic polypeptide

SEQ ID NO: 15295 - DNA, 292 bp, Artificial Sequence; identical to SEQ ID NO: 9081
  Synthetic polypeptide

SEQ ID NO: 15296 - DNA, 236 bp, Artificial Sequence; identical to SEQ ID NO: 9082
  Synthetic polypeptide

SEQ ID NO: 15297 - DNA, 682 bp, Artificial Sequence; identical to SEQ ID NO: 9083
  Synthetic polypeptide

SEQ ID NO: 15298 - DNA, 347 bp, Artificial Sequence; identical to SEQ ID NO: 9084
  Synthetic polypeptide

SEQ ID NO: 15299 - DNA, 273 bp, Artificial Sequence; identical to SEQ ID NO: 9085
  Synthetic polypeptide

SEQ ID NO: 15300 - DNA, 317 bp, Artificial Sequence; identical to SEQ ID NO: 9086
  Synthetic polypeptide

SEQ ID NO: 15301 - DNA, 369 bp, Artificial Sequence; identical to SEQ ID NO: 9087
  Synthetic polypeptide

SEQ ID NO: 15302 - DNA, 175 bp, Artificial Sequence; identical to SEQ ID NO: 9088
  Synthetic polypeptide

SEQ ID NO: 15303 - DNA, 370 bp, Artificial Sequence; identical to SEQ ID NO: 13309
  Synthetic polypeptide

SEQ ID NO: 15304 - DNA, 361 bp, Artificial Sequence; identical to SEQ ID NO: 13310
  Synthetic polypeptide

SEQ ID NO: 15305 - DNA, 1218 bp, Artificial Sequence; identical to SEQ ID NO: 8394
  Synthetic polypeptide

SEQ ID NO: 15306 - DNA, 1053 bp, Artificial Sequence; identical to SEQ ID NO: 8395
  Synthetic polypeptide

SEQ ID NO: 15307 - DNA, 942 bp, Artificial Sequence; identical to SEQ ID NO: 8396
  Synthetic polypeptide

SEQ ID NO: 15308 - DNA, 1091 bp, Artificial Sequence; identical to SEQ ID NO: 8397
  Synthetic polypeptide

SEQ ID NO: 15309 - DNA, 1418 bp, Artificial Sequence; identical to SEQ ID NO: 8618
  Synthetic polypeptide

SEQ ID NO: 15310 - DNA, 1595 bp, Artificial Sequence; identical to SEQ ID NO: 8619
  Synthetic polypeptide

SEQ ID NO: 15311 - DNA, 903 bp, Artificial Sequence; identical to SEQ ID NO: 8627
  Synthetic polypeptide

SEQ ID NO: 15312 - DNA, 2920 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15313 - DNA, 3151 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15314 - DNA, 1281 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15315 - DNA, 3133 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15316 - DNA, 2296 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15317 - DNA, 1465 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15318 - DNA, 2920 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15319 - DNA, 4725 bp, Artificial Sequence; identical to SEQ ID NO: 8344
  Synthetic polypeptide

SEQ ID NO: 15320 - DNA, 4530 bp, Artificial Sequence; identical to SEQ ID NO: 8345
  Synthetic polypeptide

SEQ ID NO: 15321 - DNA, 4557 bp, Artificial Sequence; identical to SEQ ID NO: 8346
  Synthetic polypeptide

SEQ ID NO: 15322 - DNA, 4380 bp, Artificial Sequence; identical to SEQ ID NO: 8347
  Synthetic polypeptide

SEQ ID NO: 15323 - DNA, 4548 bp, Artificial Sequence; identical to SEQ ID NO: 8348
  Synthetic polypeptide

SEQ ID NO: 15324 - DNA, 4755 bp, Artificial Sequence; identical to SEQ ID NO: 8349
  Synthetic polypeptide

SEQ ID NO: 15325 - DNA, 239 bp, Artificial Sequence; identical to SEQ ID NO: 13647
  Synthetic polypeptide

SEQ ID NO: 15326 - DNA, 379 bp, Artificial Sequence; identical to SEQ ID NO: 13648
  Synthetic polypeptide

SEQ ID NO: 15327 - DNA, 761 bp, Artificial Sequence; identical to SEQ ID NO: 13649
  Synthetic polypeptide

SEQ ID NO: 15328 - DNA, 863 bp, Artificial Sequence; identical to SEQ ID NO: 13650
  Synthetic polypeptide

SEQ ID NO: 15329 - DNA, 544 bp, Artificial Sequence; identical to SEQ ID NO: 8359
  Synthetic polypeptide

SEQ ID NO: 15330 - DNA, 841 bp, Artificial Sequence; identical to SEQ ID NO: 8360
  Synthetic polypeptide

SEQ ID NO: 15331 - DNA, 2660 bp, Artificial Sequence
  Synthetic polypeptide
gtggcatgctggagccgactcatgtcagctggtgacagctgattgtgtgaatctcttcccaacttggtgtattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtgctccctgctcttgcccccgcccctgcctgtcctttgcccacctctcccccagtgcctgccccccacgtcacaccccatgccccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtga

SEQ ID NO: 15332 - DNA, 676 bp, Artificial Sequence; identical to SEQ ID NO: 8681
  Synthetic polypeptide

SEQ ID NO: 15333 - DNA, 8628 bp, Artificial Sequence; identical to SEQ ID NO: 8507
  Synthetic polypeptide

SEQ ID NO: 15334 - DNA, 8628 bp, Artificial Sequence; identical to SEQ ID NO: 8508
  Synthetic polypeptide

SEQ ID NO: 15335 - DNA, 240 bp, Artificial Sequence; identical to SEQ ID NO: 8509
  Synthetic polypeptide

SEQ ID NO: 15336 - DNA, 336 bp, Artificial Sequence; identical to SEQ ID NO: 8510
  Synthetic polypeptide

SEQ ID NO: 15337 - DNA, 1065 bp, Artificial Sequence
  Synthetic polypeptide
ttcctattttctatcgtttactaccataaaatatatacatatctattataaaaagttaaaaattatcaaaacttatgcacacacttacagaccatgcatgatgccatttgcagttgagagaagtgtaaacaaatgtaaagatgcagtgttaaataatatctgcataaaattgactctggtacatagtatactactctagtaatttcatagccacctcttgttgctattgcggtaaactcaagtgtttttaatatcacataccacacagttttaaaatgctgtgtggtgctaattatctcctcatgggtagttcttctttctagtaaattgtctattgcagtaaaaattgatctcctgcagttctcaaaatttttttgtgtttagtccaccatgggacccatacgaagtgctaccagtgatgctggaagtgctcccaagaagcagaaaaaagtgatatgacattgcaagaaaaagttggattgcttgatacgtaccgtagactgagacctcttaagtcatgaaaatgcagcaacgctgaatgatgtaaagacattggtccagcaactatacaccacactgtgcattgagcagcaccagttaaacaaggaaagggagcttattgaaagactagaggatctcaaagagcagctggctcccctggaaaaggtacgaattgagattagcagaaaagctgagaagaggaccactttggtgctatggggtggccttgcctacatggccacacagtttggcattttggcccggcttacctggtgggaatattcctgggacatcatggagccagtaacatacttcatcacttatggaagtgccatggcaatgtatgcatattttgtaatgacacgccaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 15338 - DNA, 615 bp, Artificial Sequence
  Synthetic polypeptide
ttcctattttctatcgtttactaccataaaatatatacatatctattataaaaagttaaaaattatcaaaacttatgcacacacttacagaccatgcatgatgccatttgcagttgagagaagtgtaaacaaatgtaaagatgcagtgttaaataatatctgcataaaattgactctggtacatagtatactactctagtaatttcatagccacctcttgttgctattgcggtaaactcaagtgtttttaatatcacataccacacagttttaaaatgctgtgtggtgctaattatctcctcatgggtagttcttctttctagtaaattgtctattgcagtaaaaattgatctcctgcagttctcaaaatttttttgtgtttagtccaccatgggacccatacgaagtgctaccagtgatgctggaagtgctcccaagaagcagaaaaaagtgatatgacattgcaagaaaaagttggattgcttgatacgtaccgtagactgagacctcttaagtcatgaaaatgcagcaacgctgaatgatgtaaagacattggtccagcaactatacaccacactgtgcattgagcagcaccagttaaacaaggaaagggag

SEQ ID NO: 15339 - DNA, 509 bp, Artificial Sequence; identical to SEQ ID NO: 7445
  Synthetic polypeptide

SEQ ID NO: 15340 - DNA, 1808 bp, Artificial Sequence; identical to SEQ ID NO: 8393
  Synthetic polypeptide

SEQ ID NO: 15341 - DNA, 588 bp, Artificial Sequence; identical to SEQ ID NO: 7495
  Synthetic polypeptide

SEQ ID NO: 15342 - DNA, 1763 bp, Artificial Sequence; identical to SEQ ID NO: 8650
  Synthetic polypeptide

SEQ ID NO: 15343 - DNA, 1724 bp, Artificial Sequence; identical to SEQ ID NO: 8651
  Synthetic polypeptide

SEQ ID NO: 15344 - DNA, 796 bp, Artificial Sequence; identical to SEQ ID NO: 8676
  Synthetic polypeptide

SEQ ID NO: 15345 - DNA, 272 bp, Artificial Sequence; identical to SEQ ID NO: 8677
  Synthetic polypeptide

SEQ ID NO: 15346 - DNA, 226 bp, Artificial Sequence; identical to SEQ ID NO: 8678
  Synthetic polypeptide

SEQ ID NO: 15347 - DNA, 175 bp, Artificial Sequence; identical to SEQ ID NO: 8679
  Synthetic polypeptide

SEQ ID NO: 15348 - DNA, 2471 bp, Artificial Sequence; identical to SEQ ID NO: 576
  Synthetic polypeptide

SEQ ID NO: 15349 - DNA, 459 bp, Artificial Sequence; identical to SEQ ID NO: 8555
  Synthetic polypeptide

SEQ ID NO: 15350 - DNA, 1927 bp, Artificial Sequence; identical to SEQ ID NO: 8368
  Synthetic polypeptide

SEQ ID NO: 15351 - DNA, 1681 bp, Artificial Sequence; identical to SEQ ID NO: 8523
  Synthetic polypeptide

SEQ ID NO: 15352 - DNA, 1477 bp, Artificial Sequence
  Synthetic polypeptide
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaa

SEQ ID NO: 15353 - DNA, 1600 bp, Artificial Sequence
  Synthetic polypeptide
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagcagactgctcattcctcacattgccatgggaagttgtaatggtctctgctgcccccaagctgaggagccttagactccaatacaagggaggaaggggaagagcaagatttttattcccactgaataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggcactgcgggtgatggggaagatgatgcgagagtgttggtatgccaacggcgcagcccgcctgacggccctgcgcatcaagaagaccctctcccagctcagcgtgcaggaagacgtgaagatctaa

SEQ ID NO: 15354 - DNA, 1390 bp, Artificial Sequence
  Synthetic polypeptide
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctga

SEQ ID NO: 15355 - DNA, 1423 bp, Artificial Sequence
  Synthetic polypeptide
gaccggccacagtggctcatgcctgtaatcccaacactttggagaatgagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacgatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatag

SEQ ID NO: 15356 - DNA, 1643 bp, Artificial Sequence; identical to SEQ ID NO: 7549
  Synthetic polypeptide

SEQ ID NO: 15357 - DNA, 1457 bp, Artificial Sequence; identical to SEQ ID NO: 7550
  Synthetic polypeptide

SEQ ID NO: 15358 - DNA, 554 bp, Artificial Sequence; identical to SEQ ID NO: 8221
  Synthetic polypeptide

SEQ ID NO: 15359 - DNA, 482 bp, Artificial Sequence; identical to SEQ ID NO: 8222
  Synthetic polypeptide

SEQ ID NO: 15360 - DNA, 1227 bp, Artificial Sequence; identical to SEQ ID NO: 8469
  Synthetic polypeptide

SEQ ID NO: 15361 - DNA, 1215 bp, Artificial Sequence; identical to SEQ ID NO: 8470
  Synthetic polypeptide

SEQ ID NO: 15362 - DNA, 555 bp, Artificial Sequence; identical to SEQ ID NO: 8471
  Synthetic polypeptide

SEQ ID NO: 15363 - DNA, 300 bp, Artificial Sequence; identical to SEQ ID NO: 8472
  Synthetic polypeptide

SEQ ID NO: 15364 - DNA, 395 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15365 - DNA, 386 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15366 - DNA, 887 bp, Artificial Sequence; identical to SEQ ID NO: 12985
  Synthetic polypeptide

SEQ ID NO: 15367 - DNA, 959 bp, Artificial Sequence; identical to SEQ ID NO: 7258
  Synthetic polypeptide

SEQ ID NO: 15368 - DNA, 649 bp, Artificial Sequence; identical to SEQ ID NO: 7259
  Synthetic polypeptide

SEQ ID NO: 15369 - DNA, 1533 bp, Artificial Sequence; identical to SEQ ID NO: 8543
  Synthetic polypeptide

SEQ ID NO: 15370 - DNA, 1382 bp, Artificial Sequence; identical to SEQ ID NO: 8693
  Synthetic polypeptide

SEQ ID NO: 15371 - DNA, 1253 bp, Artificial Sequence; identical to SEQ ID NO: 8694
  Synthetic polypeptide

SEQ ID NO: 15372 - DNA, 2419 bp, Artificial Sequence; identical to SEQ ID NO: 7455
  Synthetic polypeptide

SEQ ID NO: 15373 - DNA, 198 bp, Artificial Sequence; identical to SEQ ID NO: 8406
  Synthetic polypeptide

SEQ ID NO: 15374 - DNA, 2000 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15375 - DNA, 2231 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15376 - DNA, 361 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15377 - DNA, 2213 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15378 - DNA, 1376 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15379 - DNA, 545 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15380 - DNA, 2000 bp, Artificial Sequence
  Synthetic polypeptide
gaccgggtgccgtggctcaacacctataatcccagcacttgggatgggaggctaagcaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15381 - DNA, 451 bp, Artificial Sequence; identical to SEQ ID NO: 10444
  Synthetic polypeptide

SEQ ID NO: 15382 - DNA, 513 bp, Artificial Sequence; identical to SEQ ID NO: 10445
  Synthetic polypeptide

SEQ ID NO: 15383 - DNA, 289 bp, Artificial Sequence; identical to SEQ ID NO: 10446
  Synthetic polypeptide

SEQ ID NO: 15384 - DNA, 124 bp, Artificial Sequence; identical to SEQ ID NO: 10447
  Synthetic polypeptide

SEQ ID NO: 15385 - DNA, 2593 bp, Artificial Sequence; identical to SEQ ID NO: 10448
  Synthetic polypeptide

SEQ ID NO: 15386 - DNA, 2590 bp, Artificial Sequence; identical to SEQ ID NO: 10449
  Synthetic polypeptide

SEQ ID NO: 15387 - DNA, 571 bp, Artificial Sequence; identical to SEQ ID NO: 12588
  Synthetic polypeptide

SEQ ID NO: 15388 - DNA, 307 bp, Artificial Sequence; identical to SEQ ID NO: 12589
  Synthetic polypeptide

SEQ ID NO: 15389 - DNA, 497 bp, Artificial Sequence
  Synthetic polypeptide
gaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcagtatcctttttatgatatgggccctcacattttccaaacctgtccatctgctaactattttgactgcagagccatgtccattggagcccgttcccaatcagctcgtacttacttggagagacatatgtctgaatttatggagtgtaatttaa

SEQ ID NO: 15390 - DNA, 794 bp, Artificial Sequence
  Synthetic polypeptide
gaaagtttcgaaatcagtatgacaatgatgtcactgtttggagcccccagggcaggattcatcaaattgaatatgcaatggaagctgttaaacaaggttcagccacagttggtctgaaatcaaaaactcatgcagttttggttgcattgaaaagggcgcaatcagagcttgcagctcatcagaaaaaaattctccatgttgacaaccatattggtatctcaattgcggggcttactgctgatgctagactgttatgtaattttatgcgtcaggagtgtttggattccagatttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaatgtttccattggaattgttggtaaagacttggagtttacaatctatgatgatgatgatgtgtctccattcctggaaggtcttgaagaaagaccacagagaaaggcacagcctgctcaacctgctgatgaacctgcagaaaaggctgatgaaccaatggaacattaa

SEQ ID NO: 15391 - DNA, 5258 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccagggaggcacaacctcacggtga

SEQ ID NO: 15392 - DNA, 5426 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggagagcatgcctccacctcaggcacataaccctggctgcattgtaccctcaggaagcaatggcagcagcatgccagtagaacacaatagcaaacgtgagaagaagattgactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15393 - DNA, 5282 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15394 - DNA, 5321 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaaacctcccaaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15395 - DNA, 5321 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggaggccaagtcaggtatttgcctttgattattgcttttggtccatggatgaatctaacactacaaaatacgctggtcaagaagtggttttcaagtgccttggggaaggaattcttgaaaaagcctttcaggggtataatgcgtgtatttttgcatatggacagacaggttcgggaaaatccttttccatgatgggccatgctgagcagctgggccttattccaaggctctgctgtgctttatttaaaaggatctctttggagcaaaatgagtcacagacctttaaagttgaagtgtcctatatggaaatttataatgagaaagttcgggatcttttagaccccaaagggagtagacagtctcttaaagttcgagaacataaagttttgggaccatatgtagatggtttatctcaactagctgtcactagttttgaggatattgagtcattgatgtctgagggaaataagtctcgaacggtagctgctaccaacatgaacgaagaaagcagccgctcccatgctgtgttcaacatcataatcacacagacactttatgacctgcagtctgggaattccggggagaaagtcagtaaggtcagcttggtagacctggcgggtagcgaaagagtatctaaaacaggagctgcaggagagcgactgaaagaaggcagcaacattaacaaatcgcttacaaccttggggttggttatatcatcactggctgaccaggcagctggcaagggtaaaagcaaatttgtgccttatcgagattcagtcctcacttggctgcttaaggacaacttggggggcaacagccaaacctctatgatagccacaatcagcccagccgcagacaactatgaagagaccctctccacattaagatatgcagaccgagccaaaaggattgtgaaccatgctgttgtgaatgaggaccccaacgcaaaagtgatccgagaactgcgggaggaagtcgagaaactgagagagcagctctctcaggcagaggccatgaaggcccctgaactgaaggagaagctcgaagagtctgaaaagctgataaaagaactaacagtgacttgggaagagaagctgagaaaaacagaagagatagcacaggaaagacaacgacaacttgaaagcatggggatttccctggagatgtccggtatcaaggtgggggatgacaaatgctacttagtcaatctgaatgcagaccctgctcttaacgaacttctggtttattatttaaaggatcacaccagggtgggtgcagatacctctcaagatatccagctttttggcataggaattcagcctcagcactgtgagattgacattgcatctgatggagacgtcactctcactccaaaagaaaatgcaaggtcctgtgtgaacggcacccttgtgtgcagtaccacccagctgtggcatggtgaccgaatcctatggggaaataatcacttttttagaataaacttacctaagaggaaacgtcgagattggttgaaagactttgaaaaagaaacgggcccgccagagcatgacctggatgcagccagtgaggcttcctctgaaccagactataactatgaatttgcacagatggaagttatcatgaaaaccctgaatagtaatgacccagttcaaaatgtggttcaggtcctggagaaacaatacctagaagaaaagagaagtgccctagaggagcagcggctcatgtatgagcgggaactggagcaactccgccagcagctctcccccgacaggcagccacagagtagcggccctgaccgcctggcctacagcagccagacagcgcagcagaaggtgacccagtgggcagaagagagggatgaactcttccgacaaagcctggcaaaactgcgagagcagctggttaaagctaataccttggtgagggaagcaaacttcctggctgaggaaatgagcaaactcaccgattaccaagtgactcttcagatccctgctgcaaacctcagtgccaataggaagagaggtgcaatagtgagtgaaccagctatccaagtgaggaggaaaggaaagagcacccaagtgtggaccattgagaagctggagaataaattaattgacatgagagacctttaccaagaatggaaggaaaaagttcctgaggcaaagagactctacggaaaacgaggtgaccctttctatgaagcccaagaaaatcacaacctcatcggggtggcgaatgtattcttggaatgcctcttctgtgatgtgaaacttcagtatgcagtccctatcatcagccagcagggggaggttgcagggcgtctccacgtggaagtgatgcgtgttacaggagctgttccagagcgtgtggtggaggatgactcttcggagaattccagtgaaagtgggagccttgaagtcgtagacagcagcggggaaatcattcaccgagtcaaaaagctgacatgtcgggtaaaaattaaagaagcaacggggctgcccttaaacctctcaaattttgtcttctgtcaatacacattctgggaccagtgtgagtctacggtggctgccccggtggtggaccccgaggtgccttcaccacagtccaaggatgcccagtacacagtgaccttctcccactgtaaggactatgtggtgaatgtaacagaagaatttctggagttcatttcagatggagcactggccattgaagtatggggccaccggtgtgctggaaatggcagctccatctgggaggtcgattctcttcatgctaagacaagaacactgcatgacaggtggaatgaagtaacgcgaagaatagaaatgtggatctccatattagaattgaatgagttaggagagtatgctgcagtggaacttcatcaggcaaaagatgtcaacacaggaggcatctttcaacttagacagggtcattcccgtagagtacaagtcacggtgaaacctgtgcagcattcagggacactgccacttatggttgaagccatcctgtcagtatccatcggctgtgtaactgccaggtccaccaaactccaaagagggctggacagttaccagagagatgatgaggatggtgatgatatggatagttatcaggaagaagacttaaactgcgtaagggagaggtggtcagatgcactcattaaacgacgagaatacctggatgaacagataaaaaaagtcagcaataaaacagagaaaacagaggacgatgtggagcgggaagcccagcttgtggagcagtgggtagggctgactgaggaaaggaatgctgtgctggtgccagccccaggcagtgggattcctggggcacctgccgactggatcccacctcctggaatggaaacccacataccagttctcttcctcgatttgaatgcggatgacctcagtgccaatgagcagcttgttggcccccatgcatccggcgtgaactccatcctgcccaaggagcatggcagccagtttttctacctgcccatcataaagcacagtgatgatgaggtttcagccacagcctcttgggattcctcggtgcatgattctgttcacttgaatagggtcacaccacagaatgaaaggatttacctaattgtgaaaaccacagttcaactcagccaccctgctgctatggagttagtattacgaaaacgaattgcagccaatatttacaacaaacagagtttcacgcagagtttgaagaggagaatatccctgaaaaatatattttattcctgtggtgtaacctatgaaatagtatccaatataccaaaggcaactgaggagatagaggaccgggaaacgctggctctcctggcagcaaggagtgaaaacgaaggcacatcagatggggagacgtacattgagaagtacactcgaggcgtgctgcaggtggaaaacattctgagtcttgaacggctccggcaggccgtcacagtcaaagaagcactttccaccaaagcccggcacattcggaggagcctcagtacaccaaatgttcataatgtctcttccagccgaccggacctttctggctttgatgaagatgacaagggttggccagagaaccagttggacatgtctgactatagctccagttaccaagatgtagcatgttatggaactttacccagggattctcctcgaaggaataaagaaggttgtacatcagagactcctcatgccttaaccgtcagcccttttaaagcattctctcctcagccaccaaagtttttcaagcccctaatgcctgtaaaagaggagcataagaaaaggatagccctggaagcaaggcctcttctaagccaggaggactctgaggaggaagaaaatgagctggaagctattaacaggaagctaataagttcacagccttatgtacctgtggagtttgctgacttcagtgtttacaatgccagcttggagaacagggaatggttttcctctaaagtagatctgtcaaactcacgggtcttggagaaagaagtgtcccgtagccctaccaccagcagtattaccagtggctacttttcccacagtgcctccaatgccaccctgtctgacatggtggtcccttctagtgacagctcagaccagctggccattcagacgaaggatgcagactccaccgagcactccacaccatcgcttgtgcatgatttcaggccgtcctcaaacaaagagttgacagaagtcgaaaaaggcttggtaaaggacaagataattgtggtgccactcaaggaaaacagtgccttagccaaagggagcccatcatcccagagcatccctgagaaaaactccaaatcactgtgcaggactggctcatgttcagaactagatgcctgccccagcaaaattagccagccagccaggggattctgccccagggaggtgacggtagaacacaccaccaacatccttgaagaccattctttcacagaatttatgggagtgtcagagggaaaagattttgatggtttgacagattcttctgctggagagctttccagtaggaggagtctaccaaataaaacaggcggcaagactgtctccgatgggctccaccaccccagccagctgcattccaagttagagaatgaccaggtaataattccagaggcagccttttgggttctgtgctgtcaatga

SEQ ID NO: 15396 - DNA, 221 bp, Artificial Sequence
  Synthetic polypeptide
gtggaagtgagagctgtggtttttgaagacctgcatttaaatcccaaggccatcacttcccagaactggaactgaacaccaagtgcgtggtggagatggaagggaatcaaacggtcctgcaccctcctccttctaacaccaaacagggagaaaggctggtcacagtggctcacatctctaattccagcactttgggaggccaaggcaagaggatcacttga

SEQ ID NO: 15397 - DNA, 1584 bp, Artificial Sequence; identical to SEQ ID NO: 8495
  Synthetic polypeptide

SEQ ID NO: 15398 - DNA, 1242 bp, Artificial Sequence; identical to SEQ ID NO: 8496
  Synthetic polypeptide

SEQ ID NO: 15399 - DNA, 1539 bp, Artificial Sequence; identical to SEQ ID NO: 8497
  Synthetic polypeptide

SEQ ID NO: 15400 - DNA, 1623 bp, Artificial Sequence; identical to SEQ ID NO: 8498
  Synthetic polypeptide

SEQ ID NO: 15401 - DNA, 1677 bp, Artificial Sequence; identical to SEQ ID NO: 8499
  Synthetic polypeptide

SEQ ID NO: 15402 - DNA, 1632 bp, Artificial Sequence; identical to SEQ ID NO: 8500
  Synthetic polypeptide

SEQ ID NO: 15403 - DNA, 555 bp, Artificial Sequence; identical to SEQ ID NO: 8501
  Synthetic polypeptide

SEQ ID NO: 15404 - DNA, 401 bp, Artificial Sequence; identical to SEQ ID NO: 8502
  Synthetic polypeptide

SEQ ID NO: 15405 - DNA, 166 bp, Artificial Sequence; identical to SEQ ID NO: 8503
  Synthetic polypeptide

SEQ ID NO: 15406 - DNA, 841 bp, Artificial Sequence
  Synthetic polypeptide
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctag

SEQ ID NO: 15407 - DNA, 572 bp, Artificial Sequence
  Synthetic polypeptide
aagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggacaaggtcccagaaccctgggtgccctgcagcctgggttcagtgcccggagcccgtcctacctgggaacaatgcgcggctgatcatgcccggcatgatgatcaggcccatggggagcatc

SEQ ID NO: 15408 - DNA, 2795 bp, Artificial Sequence
  Synthetic polypeptide
cttgcacatgaatgttggcagcagctttattggtagtagccccagaactggaaataaaatatttgaatagataagcagggtgtggcgcgtgcacacggtgcaccgacgccggctgtgagagggaaggagcatgcgtgcagccgcgtgggggagtctcacggtgactttaccgaggaaaatgaaccagacggaaagacagcactctgtgcgcctccacttagttgcagaacgtcaacacgcccctgatgaggaagctggcgcgcctcaagctcggcctcgtggaaatggctctggacatgctccagttcatctgggaggaggcccacgggcagcagagtgagcaggggtccctggagaagctgctggcggactatctgcagaacaccagtgactacacttccgtcggcctgcaatggttcacgctgaagcggactctagcacacggggcactggcacagctggggagcctgcagccgctgagcgtgggctgtgtggagatccgcgcccggctcctgggcctggccgggagggccctgcacctgctggccatgcaagctgaccctgtgcaccctacctgctactgggaggcgggcccctcggtgggcgccaagctgagcggcctcaagtctctggagctggaggtagaggaagagggtgccacaaagtccagcagggacccgccggcctccagggcagccccggaggagcactgcaggagaggcgaggacctgaagaggaggatggttctggcccagcagtacctggctcaggcgtcagaggtgctgctgcagtgcctacaggtggcccttggcagtggcctcctggatgtcgcagcagccgccagcctggagatggtggagtgtgtcggcaccctggaccctgcaactacctgccagttcctggctctgtctcagagctgctcggcctcagagacgatgagggatgtcctgcttgcagccacagccaacaccagcagctcacagctggcggccctgctgcagctacagcaccagctccggtgccaagacaggaccaccaccagcctgggcgcccgtgtggagcagaggctggccgccgtgtccaaggcttggcaaaatctctgcgtcactgagcagcattttaacctcttgaatgagatgcctccgaccttttggatcctctttctgcacctctcaggggacaggtcccgtctgtacggcgctgcctacgagaaacccaagttcattactgcagccaaaggaaaggtgcaggcggtgggaggctcctgcaaggtgatgcgtctggccataagtcccactgccttctcccacctgctggcctgtgcccagcagttccggaagcagacccaggcccaggtgtacagtgaggacatggccctgaacataggctcggaaccagaaggcctgcaggtggaagagaaggagcgccctgtgcagaggctcagtagcgtcctggggcccctggaggagcttctgcagccgctattccccctgctcagcctctccaaggccagagtgcagacacctgcggttgttgccgattcagggaagtcgaagggcaaagacaaggagaggaaaacgtccacaggacaacacagcacagtccagcctgaggttgccgataagatagtcctggtcgcagacagacatctcctggagctgccactggaaggtctctctgtgttcgatgaagggacaatttcctctgtgtcacgagaattttctcttcaaatgctgtggaatcgcctccataaagaagagacagaaggtggcgtgaaaaaggagggaagaagcagagaccccaaaaagagaagcctagcgaagaagggcaggaagggcagcatcccccggaccatcccccctgactgcatcatagtcgactcagacaacttcaagttcgtcgtggacccatacgaggaggcccagggcccagaaatgctaactcctgtctccatcacccaagacattttggaaagattccaagacacattcacgtcgcgatgggcgggacatctgggaagcaagcactttcccagccaggcccagtgggagcaggccctgggcagctgcagcggtttcttcttctatggaatggagagcttcctgtcccatatattagtggagagattggtcgccatgaacttgcaagagtgccaggtggcagtcctgctggacctggcgcggtcctaccagagcttgaagaggcacatggagagcgtggagcacaggagatctgttggccgttgggaagccaattggagaaacagtgcgtctccttcagaagatgagtggcgacgaggcggtgaaccaagacgaggcttctcagaccttgaaggacaagctgctgctgctccaaagctccgagctccttcccaccacgctcaacttggtcctgtatgggctgccgcaccaagccatcgggtagtgcaggcctggacctgcctcccatcagctgctggggccccagcacttgcctctgcccttggctctgcccctctgccaacccatccccacctcccggctcccatccccagctcccagctcgctctccccttcctgggcctctccccagcccttggtgcagcctcagccagggaccctcccccagcgacttcccgcaaggcagccgcctggacctcgagctctgcctgcctgtgtgcgccatggggtctgcgtcggggctggagctgcgtctcttcccggggccaggacaagggcggcctccccttggcggcgctggtgctgagttgcttagaccagaagactattcagaccgtgagcctgtttttgatttga

SEQ ID NO: 15409 - DNA, 732 bp, Artificial Sequence; identical to SEQ ID NO: 7769
  Synthetic polypeptide

SEQ ID NO: 15410 - DNA, 879 bp, Artificial Sequence; identical to SEQ ID NO: 7770
  Synthetic polypeptide

SEQ ID NO: 15411 - DNA, 99 bp, Artificial Sequence; identical to SEQ ID NO: 7771
  Synthetic polypeptide

SEQ ID NO: 15412 - DNA, 503 bp, Artificial Sequence
  Synthetic polypeptide
ggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggtgagagtttcacagctgctggcagtaactggcaagaagacaacaagaccctag

SEQ ID NO: 15413 - DNA, 234 bp, Artificial Sequence
  Synthetic polypeptide
ggcggcggcggcggcggcggcggccgggggcgattaagtacacgggcttcagggaccggccccacgaggaacgccaggcacgcttccagaacgcctgccgcgacggccgctcggaaatcgtatatttgaaggctcccatgattctgaatggagtctgtgttatctggaaaggctggattgatctccaaagactggatggtatgggctgtctggagtttgatgaggagcgagccc

SEQ ID NO: 15414 - DNA, 518 bp, Artificial Sequence
  Synthetic polypeptide
ggcggcggcggcggcggcggcggccgggggcgattaagtacacgggcttcagggaccggccccacgaggaacgccaggcacgcttccagaacgcctgccgcgacggccgctcggaaatcgcttttgtggccacaggaaccaatctgtctctccagttttttccggccagctggcagggagaacagcgacaaacacctagccgagagtatgtcgacttagaaagagaagcaggcaaggtatatttgaaggctcccatgattctgaatggagtctgtgttatctggaaaggctggattgatctccaaagactggatggtatgggctgtctggagtttgatgaggagcgagcccagcaggaggatgcattagcacaacaggcctttgaagaggctcggagaaggacacgcgaatttgaagatagagacaggtctcatcgggaggaaatggaggcaagaagacaacaagaccctagtcctggttccaatttaggtggtggtgatgacctcaaacttcgttaa

SEQ ID NO: 15415 - DNA, 188 bp, Artificial Sequence
  Synthetic polypeptide
ggcggcggcggcggcggcggcggccgggggcgattaagtacacgggcttcagggaccggccccacgaggaacgccaggcacgcttccagaacgcctgccgcgacggccgctcggaaatcgcaagaagacaacaagaccctagtcctggttccaatttaggtggtggtgatgacctcaaacttcgttaa

SEQ ID NO: 15416 - DNA, 564 bp, Artificial Sequence; identical to SEQ ID NO: 8405
  Synthetic polypeptide

SEQ ID NO: 15417 - DNA, 1285 bp, Artificial Sequence
  Synthetic polypeptide
aaaaaaaaaaaaaaaaaaaaaaaaaaaaaaaaaaaaaaaaaagaggatcggaagagtcttcaaaaacgcactgcaagaagctgaagctcgttttcgtgaaattaagcttcagagggaagcccgagaaacacaggagagcgagcgcaagcccccaccatacaagcacatcaaggtgaataagccttacgggaaagtccagatctacacagcggatatttcagaaatccctaagtgcaactgcaagcccacagatgagaatccttgtggctttgattcggagtgtctgaacaggatgctgatgtttgagtgccacccgcaggtgtgtcccgcgggcgagttctgccagaaccagtgcttcaccaagcgccagtacccagagaccaagatcatcaagacagatggcaaagggtggggcctggtcgccaagagggacatcagaaagggagaatttgttaacgagtacgttggggagctgatcgacgaggaggagtgcatggcgagaatcaagcacgcacacgagaacgacatcacccacttctacatgctcactatagacaaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcagggacggagctgacttttaactacaacctcgattgtctgggcaatgaaaaaacggtctgccggtgtggagcctccaattgcagtggattcctcggggatagaccaaagacctcgacgaccctttcatcagaggaaaagggcaaaaagaccaagaagaaaacgaggcggcgcagagcaaaaggggaagggaagaggcagtcagaggacgagtgcttccgctgcggtgatggcgggcagctggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaagactgagaagccccccccagagccagggaagccgaaggggaagaggcggcggcggaggggctggcggagagtcacagagggcaaatag

SEQ ID NO: 15418 - DNA, 68 bp, Artificial Sequence
  Synthetic polypeptide
aaaaaaaaaaaaaaaaaaaaaaaaaaaaaaaaaaaaaaaaaagaggatcggaagagtcttcaaaaacg

SEQ ID NO: 15419 - DNA, 567 bp, Artificial Sequence
  Synthetic polypeptide
gccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtctttgtgcaattgctggagtgtctgtgtttgccaacatgctggtgactaacttctggatgtccacagctaacatgtacaccggcatgggtgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagatatacgatggaggtgcccgcacagaggacgaggtacaatcttatccttccaagcacgactatgtgtaa

SEQ ID NO: 15420 - DNA, 222 bp, Artificial Sequence
  Synthetic polypeptide
gccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgttcattgtctcaggtacacatttggtgcggctctgttcgtgggctgggtcgctggaggcctcacactaa

SEQ ID NO: 15421 - DNA, 2625 bp, Artificial Sequence
  Synthetic polypeptide
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15422 - DNA, 1455 bp, Artificial Sequence
  Synthetic polypeptide
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggttcacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15423 - DNA, 198 bp, Artificial Sequence
  Synthetic polypeptide
ggctctggagaaaaactgcctgagttcactccccagcccagccgcctcaggaccttcacggcatggtgcaactcccacctgcggaaggcaggcacacagatcgagaacattgatgaggacttccgagacgggctcaagctcatgctgctcctggaggtcatatcagaggagctgagttggcagaccgggcccccctga

SEQ ID NO: 15424 - DNA, 6463 bp, Artificial Sequence; identical to SEQ ID NO: 8580
  Synthetic polypeptide

SEQ ID NO: 15425 - DNA, 1571 bp, Artificial Sequence; identical to SEQ ID NO: 6810
  Synthetic polypeptide

SEQ ID NO: 15426 - DNA, 1151 bp, Artificial Sequence; identical to SEQ ID NO: 13411
  Synthetic polypeptide

SEQ ID NO: 15427 - DNA, 3171 bp, Artificial Sequence
  Synthetic polypeptide
cttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttga

SEQ ID NO: 15428 - DNA, 466 bp, Artificial Sequence; identical to SEQ ID NO: 8369
  Synthetic polypeptide

SEQ ID NO: 15429 - DNA, 526 bp, Artificial Sequence; identical to SEQ ID NO: 8370
  Synthetic polypeptide

SEQ ID NO: 15430 - DNA, 319 bp, Artificial Sequence; identical to SEQ ID NO: 8371
  Synthetic polypeptide

SEQ ID NO: 15431 - DNA, 520 bp, Artificial Sequence; identical to SEQ ID NO: 8372
  Synthetic polypeptide

SEQ ID NO: 15432 - DNA, 3180 bp, Artificial Sequence
  Synthetic polypeptide
agcacccctcttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacgtga

SEQ ID NO: 15433 - DNA, 3315 bp, Artificial Sequence
  Synthetic polypeptide
agcacccctcttggcacacagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccaaacacacctcagctggctgacattgttgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaacccagggacttacaaagtgcaggtgatggttcctgaggcagaaaccagagcagggctgacgttgaaaccccagacatttcctcttactgtgaccgacaggcctgtgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacgtgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggtgaagaaagaatgaccaagcctcctgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccacgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcagtggaaggaaccatcggagacttcaaggcctatgccctggcaggcgtaagctttgagataaaagctgaggatgaccagcccctcccgggagtcctcttatccctgagtggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacgttatgggtcaagctttacaaaagcgaaaacctcgacaatccaatccagacagtttcccttggccagtccctgttcttccatttccccccactgctcagagatggcgagaactatgttgtgcttctggactccacactccccagatcccagtatgactacatcttgcctcaagtttctttcaccgcagtgggctaccataaacacatcaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtcggcgcgctcggccaggcagcctctgacaatagcggcccagaagatgcaaagagacaagccaagaaacagaagacaaggcggacccttcgtttgcaagaagagttccagttgatgtggtgtttggttccatggcggggtaccctagggattcatctgttttcttcacttccctttgcatctgagatcctgctggaaaccacggcaacctgtatccactattag

SEQ ID NO: 15434 - DNA, 35 bp, Artificial Sequence
  Synthetic polypeptide
agcacccctcttggcacacagtttgcattttttaa

SEQ ID NO: 15435 - DNA, 967 bp, Artificial Sequence
  Synthetic polypeptide
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaa

SEQ ID NO: 15436 - DNA, 1839 bp, Artificial Sequence
  Synthetic polypeptide
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaagtaagaattaa

SEQ ID NO: 15437 - DNA, 1842 bp, Artificial Sequence
  Synthetic polypeptide
gctgggcatggtggctcacgcctgtaatcccagcactttgggaggccaagacacgcagatcacttggggtcaggagttggagaccagcctggccaacatggtgaaaccccatctctactaaaaatacagaaattagccaggcgtgatggtgcacacctgtagtaccagctactcaggaggctgaggcaggagaattgcttgaacccagcatgcagaagttgcagtgacctgagactacgacactacactccagcctggattgaggacataaacaatacgggaactgaatcagcatcagaggaaggagatgattcactacttataactgtggtacctgtcaaatcatataaaacatctggaaaaatgaaaaagaattttgaggatctagaaaaagaacgtgaagagaaagaaaggatcaagtacgaggaagataaaagaataagatatgaagaacaacgaccatctctcaaggaagcaaagtgtctttcattagttatggatgatgaaatagaaagtgaagcaaaaaaagaatcactttctcccggaaaattgaaactaacttttgaagaactggagcgacaaagacaagaaaaccgaaagaagcaagctgaagaggaagcaagaaaacgtttagaagaagagaagcgtgcttttgaagaagcaaggcggcaaatggtaaatgaagatgaggaaaaccaagacacagcaaaaatttttaaagggtaccgccctggtaaactcaaactcagttttgaagaaatggaaaggcaaagaagagaagatgaaaaaaggaaagcagaagaagaagccagaaggagaatagaggaagaaaagaaggcgtttgctgaagcaaggagaaatatggtagtagatgatgactccccagagatgtataagacaatctctcaagaatttcttacaccgggaaaactggaaattaattttgaagaattattaaaacaaaaaatggaagaagaaaaacgacgaacagaggaggaacggaagcataagctagaaatggagaaacaagaatttgaacaactgagacaggaaatgggagaggaagaggaagaaaatgaaacctttggattgagcagagaatatgaagaactgatcaaattaaaaaggagtggctctattcaagctaaaaacctaaaaagcaagtttgaaaaaattggacagttgtctgaaaaagaaatacagaaaaaaatagaagaagagcgagcaagaaggagagcaattgaccttgaaattaaagagcgagaagctgaaaattttcatgaggaagatgatgttgatgttaggcctgcaagaaaaagcgaggctccatttactcacaaagtgaatatgaaagctagatttgaacaaatggctaaggcaagagaagaagaagaacaaagaagaattgaagaacaaaagttactacgcatgcagtttgaacaaagggaaattgatgcagcactacaaaagaaaagagaagaggaggaggaggaagaaggtagcatcatgaatggctccactgctgaagatgaagagcaaaccagatcaggagctccatggttcaagaagcctcttaaaaacacatcagttgtagacagtgagccagtcagatttacggttaaagtaacaggagaacccaaaccagaaattacatggtggtttgaaggagaaatactgcaggatggagaagactatcaatatattgaaaggggagaaacttactgcctttacttaccagaaactttcccagaagatggaggagagtatatgtgtaaagcagtcaacaataaaggatctgcagctagtacctgtattcttaccattgaaactgatgactactag

SEQ ID NO: 15438 - DNA, 1084 bp, Artificial Sequence; identical to SEQ ID NO: 580
  Synthetic polypeptide

SEQ ID NO: 15439 - DNA, 117 bp, Artificial Sequence; identical to SEQ ID NO: 8388
  Synthetic polypeptide

SEQ ID NO: 15440 - DNA, 1110 bp, Artificial Sequence; identical to SEQ ID NO: 8310
  Synthetic polypeptide

SEQ ID NO: 15441 - DNA, 358 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15442 - DNA, 349 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15443 - DNA, 864 bp, Artificial Sequence; identical to SEQ ID NO: 6737
  Synthetic polypeptide

SEQ ID NO: 15444 - DNA, 619 bp, Artificial Sequence
  Synthetic polypeptide
tcctaacccagggctcaaagaccagtgtgtgagcctcagggggcgtgtctctaagctcccggaaaccaagccaattttcgcatgcgtgttcttctttgctttttttctgggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaa

SEQ ID NO: 15445 - DNA, 864 bp, Artificial Sequence; identical to SEQ ID NO: 6975
  Synthetic polypeptide

SEQ ID NO: 15446 - DNA, 471 bp, Artificial Sequence; identical to SEQ ID NO: 6976
  Synthetic polypeptide

SEQ ID NO: 15447 - DNA, 380 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 15448 - DNA, 442 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 15449 - DNA, 218 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 15450 - DNA, 2075 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15451 - DNA, 2522 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15452 - DNA, 2519 bp, Artificial Sequence
  Synthetic polypeptide
actggaaggcagaagccacgcagacttctagtcctggttccactgcttactcgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 15453 - DNA, 1508 bp, Artificial Sequence; identical to SEQ ID NO: 7729
  Synthetic polypeptide

SEQ ID NO: 15454 - DNA, 603 bp, Artificial Sequence; identical to SEQ ID NO: 7730
  Synthetic polypeptide

SEQ ID NO: 15455 - DNA, 909 bp, Artificial Sequence; identical to SEQ ID NO: 7731
  Synthetic polypeptide

SEQ ID NO: 15456 - DNA, 12665 bp, Artificial Sequence; identical to SEQ ID NO: 8581
  Synthetic polypeptide

SEQ ID NO: 15457 - DNA, 4559 bp, Artificial Sequence; identical to SEQ ID NO: 8582
  Synthetic polypeptide

SEQ ID NO: 15458 - DNA, 3692 bp, Artificial Sequence; identical to SEQ ID NO: 8610
  Synthetic polypeptide

SEQ ID NO: 15459 - DNA, 3536 bp, Artificial Sequence; identical to SEQ ID NO: 8611
  Synthetic polypeptide

SEQ ID NO: 15460 - DNA, 3647 bp, Artificial Sequence; identical to SEQ ID NO: 8612
  Synthetic polypeptide

SEQ ID NO: 15461 - DNA, 2158 bp, Artificial Sequence; identical to SEQ ID NO: 8400
  Synthetic polypeptide

SEQ ID NO: 15462 - DNA, 2224 bp, Artificial Sequence; identical to SEQ ID NO: 8401
  Synthetic polypeptide

SEQ ID NO: 15463 - DNA, 2143 bp, Artificial Sequence; identical to SEQ ID NO: 8402
  Synthetic polypeptide

SEQ ID NO: 15464 - DNA, 796 bp, Artificial Sequence; identical to SEQ ID NO: 8403
  Synthetic polypeptide

SEQ ID NO: 15465 - DNA, 740 bp, Artificial Sequence; identical to SEQ ID NO: 7794
  Synthetic polypeptide

SEQ ID NO: 15466 - DNA, 2433 bp, Artificial Sequence; identical to SEQ ID NO: 8511
  Synthetic polypeptide

SEQ ID NO: 15467 - DNA, 380 bp, Artificial Sequence; identical to SEQ ID NO: 8512
  Synthetic polypeptide

SEQ ID NO: 15468 - DNA, 257 bp, Artificial Sequence; identical to SEQ ID NO: 8513
  Synthetic polypeptide

SEQ ID NO: 15469 - DNA, 250 bp, Artificial Sequence; identical to SEQ ID NO: 8514
  Synthetic polypeptide

SEQ ID NO: 15470 - DNA, 285 bp, Artificial Sequence; identical to SEQ ID NO: 6932
  Synthetic polypeptide

SEQ ID NO: 15471 - DNA, 333 bp, Artificial Sequence; identical to SEQ ID NO: 6933
  Synthetic polypeptide

SEQ ID NO: 15472 - DNA, 207 bp, Artificial Sequence; identical to SEQ ID NO: 6934
  Synthetic polypeptide

SEQ ID NO: 15473 - DNA, 555 bp, Artificial Sequence; identical to SEQ ID NO: 6935
  Synthetic polypeptide

SEQ ID NO: 15474 - DNA, 225 bp, Artificial Sequence; identical to SEQ ID NO: 6936
  Synthetic polypeptide

SEQ ID NO: 15475 - DNA, 308 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgct

SEQ ID NO: 15476 - DNA, 649 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttc

SEQ ID NO: 15477 - DNA, 491 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccggga

SEQ ID NO: 15478 - DNA, 501 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttc

SEQ ID NO: 15479 - DNA, 3076 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacaggggtggcctacacttcagaatgcttcccctgcaaacctggcacgtatgcagacaagcagggctcctctttctgcaaactttgcccagccaactcttattcaaataaaggagaaacttcttgccaccagtgtgaccctgacaaatactcagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 15480 - DNA, 2739 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctggtgagaaacattgccataacagagaaaggatcttcttcctgtaacgtgcgcccagcttgcacagacaaagattatttctacacacacacggcctgcgatgccaacggagagacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaagga

SEQ ID NO: 15481 - DNA, 2815 bp, Artificial Sequence
  Synthetic polypeptide
ggccggcatggtggttcacacctgaatcccagcactttgggaggctgaggcaggcagatcgctttgagctcaggagttcaagaccagcctgggcaacatggcaaaaccccatctctattaaaaatacaaaaaaattagccaggcatggtggtgcatgcctgtaatcccagctattcgggaggctgagtctgagtaccactatgagtacacggcgtgtgacagcacgggttccaggtggagggtcgccgtgccgcataccccgggcctgtgcaccagcctgcctgaccccatcaagggcaccgagtgctccttctcctgcaacgccggggagtttctggatatgaaggaccagtcatgtaagccatgcgctgagggccgctactccctcggcacaggcattcggtttgatgagtgggatgagctgccccatggctttgccagcctctcagccaacatggagctggatgacagtgctgctgagtccaccgggaactgtacttcgtccaagtgggttccccggggcgactacatcgcctccaacacggacgaatgcacagccacactgatgtacgccgtcaacctgaagcaatctggcaccgttaacttcgaatactactatccagactccagcatcatctttgagtttttcgttcagaatgaccagtgccagcccaatgcagatgactccaggtggatgaagaccacagagaaaggatgggaattccacagtgtggagctaaatcgaggcaataatgtcctctattggagaaccacagccttctcagtatggaccaaagtacccaagcctgtgctgacacaactcatgtacaaatgggccaagccgaaaatctgtagcgaggaccttgagggggcagtgaagctgcctgcctctggtgtgaagacccactgcccaccctgcaacccaggcttcttcaaaaccaacaacagcacctgccagccctgcccatatggttcctactccaatggctcagactgtacccgctgccctgcagggactgaacctgctgtgggatttgaatacaaatggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggtgtggcctcctactgccgtccctgtgccctagaagcctctgatgtgggctcctcctgcacctcttgtcctgctggttactatattgaccgagattcaggaacctgccactcctgccccactaacacaattctgaaagcccaccagccttatggtgtccaggcctgtgtgccctgtggtccagggaccaagaacaacaagatccactctctgtgctacaacgattgcaccttctcacgcaacactccgaccaggactttcaactacaacttctccgctttggcaaacactgtcactcttgctggagggccaagcttcacttccaaagggctgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcggatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagaggactcctgatggatttgactcagtgccgctgaagacatcctcaggaggcctagacatggacctgtga

SEQ ID NO: 15482 - DNA, 574 bp, Artificial Sequence
  Synthetic polypeptide
ttttttaaaaatgagacagtattgcatacacagcagaatggctaacgtcttttaaactggcaatatcaagtattggcaagggtgtggaatggtggtacctcataatcctgctgatagaagtataattggtacaaccattttggaaactgtttatcatcactgcttacatttgaacacatgcataccctgtgatctaagatttccactcctaggtatatctccagcagaagagataaatccagaaatgcttttggcagcattattagtaagaacggaaacaacccaaaagcttatcaatagtagaatggttaaataaactatgatgaagtcacacaatataatataatggaaatgaatagactgcagctacacacaaaaggaatatgtttatccagaagccagagacagacaatacttactatttttccataaaggagccaaaaagtcacgttttgacctagagaaatacaatcaactcaaggatgcaattgctcaggcagaaatggaccttaagagactgagagacccattacaagtacatctgcctctccgacaaattggtgaaaaagattga

SEQ ID NO: 15483 - DNA, 1052 bp, Artificial Sequence; identical to SEQ ID NO: 13297
  Synthetic polypeptide

SEQ ID NO: 15484 - DNA, 483 bp, Artificial Sequence; identical to SEQ ID NO: 13298
  Synthetic polypeptide

SEQ ID NO: 15485 - DNA, 402 bp, Artificial Sequence; identical to SEQ ID NO: 13299
  Synthetic polypeptide

SEQ ID NO: 15486 - DNA, 230 bp, Artificial Sequence; identical to SEQ ID NO: 13300
  Synthetic polypeptide

SEQ ID NO: 15487 - DNA, 866 bp, Artificial Sequence; identical to SEQ ID NO: 13301
  Synthetic polypeptide

SEQ ID NO: 15488 - DNA, 365 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 15489 - DNA, 356 bp, Artificial Sequence
  Synthetic polypeptide
ataaaggacaaaaggcatataattatctcaacagatgcaggaagagctcacaaaaactgacaccctttcatgtttaataaaaagcaaaacactgaacaaaacagtagacgggtacttcctcaatctgataaagggcatctacaaaaacatctaacccagtgtgaaagactgaaagctttaagatcaggaacaatgcaaaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 15490 - DNA, 477 bp, Artificial Sequence; identical to SEQ ID NO: 8538
  Synthetic polypeptide

SEQ ID NO: 15491 - DNA, 1219 bp, Artificial Sequence; identical to SEQ ID NO: 7808
  Synthetic polypeptide

SEQ ID NO: 15492 - DNA, 2887 bp, Artificial Sequence; identical to SEQ ID NO: 8311
  Synthetic polypeptide

SEQ ID NO: 15493 - DNA, 2941 bp, Artificial Sequence; identical to SEQ ID NO: 8312
  Synthetic polypeptide

SEQ ID NO: 15494 - DNA, 2980 bp, Artificial Sequence; identical to SEQ ID NO: 8313
  Synthetic polypeptide

SEQ ID NO: 15495 - DNA, 2887 bp, Artificial Sequence; identical to SEQ ID NO: 8314
  Synthetic polypeptide

SEQ ID NO: 15496 - DNA, 3046 bp, Artificial Sequence; identical to SEQ ID NO: 8315
  Synthetic polypeptide

SEQ ID NO: 15497 - DNA, 2959 bp, Artificial Sequence; identical to SEQ ID NO: 8316
  Synthetic polypeptide

SEQ ID NO: 15498 - DNA, 2941 bp, Artificial Sequence; identical to SEQ ID NO: 8317
  Synthetic polypeptide

SEQ ID NO: 15499 - DNA, 940 bp, Artificial Sequence; identical to SEQ ID NO: 8318
  Synthetic polypeptide

SEQ ID NO: 15500 - DNA, 768 bp, Artificial Sequence
  Synthetic polypeptide
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatga

SEQ ID NO: 15501 - DNA, 876 bp, Artificial Sequence
  Synthetic polypeptide
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacataggtataaacaacataaaactgacttggaagcgattcctcagcagtgccccattgatctgccctgccaagtgactggctgccagtgcagggcttacctttatgtccccttgaatggtagccagcccattcgctgcaggtgcaaacactttgctgatcagcacagtgctgcgcctggctttacatgcaatacatgttccaagtgttcaggattccatagctgcttcacttgtgcttgtggtcagcctgcatatgcccatgacacagtagtggaaactaagcaagaaagattggctcaggaaaaaccagtgggacaggacattccttatgcagccatgggaggattaactggtttcagctcgctggcggaaggctacatgcggttagatgacagtgggattggtgtaccttcagttgaatttttagaatctcccattacggcagtagacagcccattcctaaaagcatttcaagcatcatctagttcttctccagaaacgttaacagatgtaggtacaagtagtcaagtttcttcattaaggagacctgaagaggatgatatggctttctttgaaagacgataccaggaaaggatgaaaatggaaaaggctgctaagtggaaaggaaaagctccattgccatcagctacaaaaccttcatga

SEQ ID NO: 15502 - DNA, 324 bp, Artificial Sequence
  Synthetic polypeptide
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagggtcttactctgtcactcaggttggagtgcagtggcacgatcttggctcattgcagcctcgacctcctgggctcaagcgatccttcgacctcagcctcccaagtag

SEQ ID NO: 15503 - DNA, 276 bp, Artificial Sequence
  Synthetic polypeptide
tgtgagtcttaatctgcatttgagcaagatcccctggggattctaattgttggtgaggatgatggagggaaactttttactcctgaagaatatgaagaatacaaaagaaaagttttacctctgcgcttacaaaacagattatttgtgagctggcggtcaccaacagggatggattgtaaacttgtgggcccagagacactgtgtttttgtacacatagtagagacggagggtttcaccgtgttagccaggatggtctggatctcctgaccttgtga

SEQ ID NO: 15504 - DNA, 763 bp, Artificial Sequence; identical to SEQ ID NO: 606
  Synthetic polypeptide

SEQ ID NO: 15505 - DNA, 303 bp, Artificial Sequence
  Synthetic polypeptide
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagcaagagacccaaaagattcaatcaaatgatggaaaggaattggatataa

SEQ ID NO: 15506 - DNA, 1080 bp, Artificial Sequence
  Synthetic polypeptide
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaa

SEQ ID NO: 15507 - DNA, 912 bp, Artificial Sequence
  Synthetic polypeptide
aaagcacaggcaacaaaactaaaaattgacaaatgggattacatcaaattgaaaagctcctgtacagcaaaagaaaactatcaacagagtcaaaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaa

SEQ ID NO: 15508 - DNA, 2397 bp, Artificial Sequence; identical to SEQ ID NO: 8486
  Synthetic polypeptide

SEQ ID NO: 15509 - DNA, 2412 bp, Artificial Sequence; identical to SEQ ID NO: 8487
  Synthetic polypeptide

SEQ ID NO: 15510 - DNA, 55 bp, Artificial Sequence; identical to SEQ ID NO: 8488
  Synthetic polypeptide

SEQ ID NO: 15511 - DNA, 2328 bp, Artificial Sequence; identical to SEQ ID NO: 8489
  Synthetic polypeptide

SEQ ID NO: 15512 - DNA, 249 bp, Artificial Sequence; identical to SEQ ID NO: 8490
  Synthetic polypeptide

SEQ ID NO: 15513 - DNA, 316 bp, Artificial Sequence; identical to SEQ ID NO: 8692
  Synthetic polypeptide

SEQ ID NO: 15514 - DNA, 387 bp, Artificial Sequence; identical to SEQ ID NO: 544
  Synthetic polypeptide

SEQ ID NO: 15515 - DNA, 540 bp, Artificial Sequence; identical to SEQ ID NO: 545
  Synthetic polypeptide

SEQ ID NO: 15516 - DNA, 303 bp, Artificial Sequence; identical to SEQ ID NO: 547
  Synthetic polypeptide

SEQ ID NO: 15517 - DNA, 7988 bp, Artificial Sequence; identical to SEQ ID NO: 8551
  Synthetic polypeptide

SEQ ID NO: 15518 - DNA, 1301 bp, Artificial Sequence; identical to SEQ ID NO: 8552
  Synthetic polypeptide

SEQ ID NO: 15519 - DNA, 806 bp, Artificial Sequence; identical to SEQ ID NO: 8266
  Synthetic polypeptide

SEQ ID NO: 15520 - DNA, 586 bp, Artificial Sequence; identical to SEQ ID NO: 6809
  Synthetic polypeptide

SEQ ID NO: 15521 - DNA, 162 bp, Artificial Sequence; identical to SEQ ID NO: 13406
  Synthetic polypeptide

SEQ ID NO: 15522 - DNA, 372 bp, Artificial Sequence; identical to SEQ ID NO: 13407
  Synthetic polypeptide

SEQ ID NO: 15523 - DNA, 3162 bp, Artificial Sequence
  Synthetic polypeptide
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggaggctgatggatgtgctgactagtgagagtgcttgggccctcccccagcacctagggaaaggcttcccctccccctccggccacaaggtccctgggtggcacgggaggatggactga

SEQ ID NO: 15524 - DNA, 3390 bp, Artificial Sequence
  Synthetic polypeptide
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctag

SEQ ID NO: 15525 - DNA, 1359 bp, Artificial Sequence
  Synthetic polypeptide
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaagacagaataa

SEQ ID NO: 15526 - DNA, 994 bp, Artificial Sequence
  Synthetic polypeptide
cctgggtttgagtcctgcatctgcaccaagacctcagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgg

SEQ ID NO: 15527 - DNA, 628 bp, Artificial Sequence; identical to SEQ ID NO: 8616
  Synthetic polypeptide

SEQ ID NO: 15528 - DNA, 568 bp, Artificial Sequence; identical to SEQ ID NO: 6787
  Synthetic polypeptide

SEQ ID NO: 15529 - DNA, 181 bp, Artificial Sequence; identical to SEQ ID NO: 6788
  Synthetic polypeptide

SEQ ID NO: 15530 - DNA, 861 bp, Artificial Sequence; identical to SEQ ID NO: 604
  Synthetic polypeptide

SEQ ID NO: 15531 - DNA, 2256 bp, Artificial Sequence; identical to SEQ ID NO: 8407
  Synthetic polypeptide

SEQ ID NO: 15532 - DNA, 411 bp, Artificial Sequence; identical to SEQ ID NO: 6630
  Synthetic polypeptide

SEQ ID NO: 15533 - DNA, 287 bp, Artificial Sequence; identical to SEQ ID NO: 7101
  Synthetic polypeptide

SEQ ID NO: 15534 - DNA, 281 bp, Artificial Sequence; identical to SEQ ID NO: 7102
  Synthetic polypeptide

SEQ ID NO: 15535 - DNA, 943 bp, Artificial Sequence; identical to SEQ ID NO: 6540
  Synthetic polypeptide

SEQ ID NO: 15536 - DNA, 2786 bp, Artificial Sequence
  Synthetic polypeptide
gctattgttagcgttttctagcaataaaatatttttaaattaagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttag

SEQ ID NO: 15537 - DNA, 347 bp, Artificial Sequence; identical to SEQ ID NO: 452
  Synthetic polypeptide

SEQ ID NO: 15538 - DNA, 148 bp, Artificial Sequence; identical to SEQ ID NO: 454
  Synthetic polypeptide

SEQ ID NO: 15539 - DNA, 127 bp, Artificial Sequence; identical to SEQ ID NO: 8697
  Synthetic polypeptide

SEQ ID NO: 15540 - DNA, 870 bp, Artificial Sequence
  Synthetic polypeptide
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctag

SEQ ID NO: 15541 - DNA, 715 bp, Artificial Sequence
  Synthetic polypeptide
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcg

SEQ ID NO: 15542 - DNA, 516 bp, Artificial Sequence
  Synthetic polypeptide
gagcctcgtcctccttatccataaaatggggtgacaccgacagttcctagctcgtggagctgaggtgaggagtgcatcgggtgttgggagaagctcagcaaatgcctcgcacacacggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagaaggatgcctgtggccctcggagagcacagtgtcaggcaacggaatcccagagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgg

SEQ ID NO: 15543 - DNA, 809 bp, Artificial Sequence; identical to SEQ ID NO: 8699
  Synthetic polypeptide

SEQ ID NO: 15544 - DNA, 962 bp, Artificial Sequence; identical to SEQ ID NO: 13039
  Synthetic polypeptide

SEQ ID NO: 15545 - DNA, 986 bp, Artificial Sequence; identical to SEQ ID NO: 13040
  Synthetic polypeptide

SEQ ID NO: 15546 - DNA, 399 bp, Artificial Sequence; identical to SEQ ID NO: 13041
  Synthetic polypeptide

SEQ ID NO: 15547 - DNA, 203 bp, Artificial Sequence; identical to SEQ ID NO: 13042
  Synthetic polypeptide

SEQ ID NO: 15548 - DNA, 186 bp, Artificial Sequence; identical to SEQ ID NO: 13043
  Synthetic polypeptide

SEQ ID NO: 15549 - DNA, 122 bp, Artificial Sequence; identical to SEQ ID NO: 13044
  Synthetic polypeptide

SEQ ID NO: 15550 - DNA, 809 bp, Artificial Sequence; identical to SEQ ID NO: 8505
  Synthetic polypeptide

SEQ ID NO: 15551 - DNA, 809 bp, Artificial Sequence; identical to SEQ ID NO: 8506
  Synthetic polypeptide

SEQ ID NO: 15552 - DNA, 1516 bp, Artificial Sequence; identical to SEQ ID NO: 534
  Synthetic polypeptide

SEQ ID NO: 15553 - DNA, 591 bp, Artificial Sequence; identical to SEQ ID NO: 539
  Synthetic polypeptide

SEQ ID NO: 15554 - DNA, 482 bp, Artificial Sequence; identical to SEQ ID NO: 540
  Synthetic polypeptide

SEQ ID NO: 15555 - DNA, 444 bp, Artificial Sequence; identical to SEQ ID NO: 541
  Synthetic polypeptide

SEQ ID NO: 15556 - DNA, 334 bp, Artificial Sequence; identical to SEQ ID NO: 533
  Synthetic polypeptide

SEQ ID NO: 15557 - DNA, 38 bp, Artificial Sequence; identical to SEQ ID NO: 543
  Synthetic polypeptide

SEQ ID NO: 15558 - DNA, 245 bp, Artificial Sequence; identical to SEQ ID NO: 542
  Synthetic polypeptide

SEQ ID NO: 15559 - DNA, 809 bp, Artificial Sequence; identical to SEQ ID NO: 8699
  Synthetic polypeptide

SEQ ID NO: 15560 - DNA, 328 bp, Artificial Sequence; identical to SEQ ID NO: 8517
  Synthetic polypeptide

SEQ ID NO: 15561 - DNA, 1497 bp, Artificial Sequence; identical to SEQ ID NO: 8518
  Synthetic polypeptide

SEQ ID NO: 15562 - DNA, 76 bp, Artificial Sequence; identical to SEQ ID NO: 8519
  Synthetic polypeptide

SEQ ID NO: 15563 - DNA, 636 bp, Artificial Sequence; identical to SEQ ID NO: 817
  Synthetic polypeptide

SEQ ID NO: 15564 - DNA, 582 bp, Artificial Sequence; identical to SEQ ID NO: 819
  Synthetic polypeptide

SEQ ID NO: 15565 - DNA, 1319 bp, Artificial Sequence; identical to SEQ ID NO: 13416
  Synthetic polypeptide

SEQ ID NO: 15566 - DNA, 1685 bp, Artificial Sequence; identical to SEQ ID NO: 13417
  Synthetic polypeptide

SEQ ID NO: 15567 - DNA, 1535 bp, Artificial Sequence; identical to SEQ ID NO: 13418
  Synthetic polypeptide

SEQ ID NO: 15568 - DNA, 281 bp, Artificial Sequence; identical to SEQ ID NO: 9447
  Synthetic polypeptide

SEQ ID NO: 15569 - DNA, 990 bp, Artificial Sequence; identical to SEQ ID NO: 9448
  Synthetic polypeptide

SEQ ID NO: 15570 - DNA, 338 bp, Artificial Sequence; identical to SEQ ID NO: 9449
  Synthetic polypeptide

SEQ ID NO: 15571 - DNA, 367 bp, Artificial Sequence; identical to SEQ ID NO: 9450
  Synthetic polypeptide

SEQ ID NO: 15572 - DNA, 197 bp, Artificial Sequence; identical to SEQ ID NO: 9451
  Synthetic polypeptide

SEQ ID NO: 15573 - DNA, 813 bp, Artificial Sequence; identical to SEQ ID NO: 9452
  Synthetic polypeptide

SEQ ID NO: 15574 - DNA, 583 bp, Artificial Sequence; identical to SEQ ID NO: 9453
  Synthetic polypeptide

SEQ ID NO: 15575 - DNA, 795 bp, Artificial Sequence; identical to SEQ ID NO: 9454
  Synthetic polypeptide

SEQ ID NO: 15576 - DNA, 588 bp, Artificial Sequence; identical to SEQ ID NO: 9455
  Synthetic polypeptide

SEQ ID NO: 15577 - DNA, 379 bp, Artificial Sequence; identical to SEQ ID NO: 9456
  Synthetic polypeptide

SEQ ID NO: 15578 - DNA, 226 bp, Artificial Sequence; identical to SEQ ID NO: 13220
  Synthetic polypeptide

SEQ ID NO: 15579 - DNA, 129 bp, Artificial Sequence; identical to SEQ ID NO: 13221
  Synthetic polypeptide

SEQ ID NO: 15580 - DNA, 655 bp, Artificial Sequence
  Synthetic polypeptide
gggaaaagtgggctgtaatggagaatatcaaggcttggcagtcagactggcctggatttgaatcctgccacttacattgcttcatctcactgaggctcagtttcttccacggaccactaggttgattaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaa

SEQ ID NO: 15581 - DNA, 556 bp, Artificial Sequence
  Synthetic polypeptide
gggaaaagtgggctgtaatggagaatatcaaggcttggcagtcagactggcctggatttgaatcctgccacttacattgcttcatctcactgaggctcagtttcttccacggaccactaggttgattaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttga

SEQ ID NO: 15582 - DNA, 1093 bp, Artificial Sequence; identical to SEQ ID NO: 7796
  Synthetic polypeptide

SEQ ID NO: 15583 - DNA, 2636 bp, Artificial Sequence; identical to SEQ ID NO: 8432
  Synthetic polypeptide

SEQ ID NO: 15584 - DNA, 3776 bp, Artificial Sequence; identical to SEQ ID NO: 8433
  Synthetic polypeptide

SEQ ID NO: 15585 - DNA, 796 bp, Artificial Sequence; identical to SEQ ID NO: 8652
  Synthetic polypeptide

SEQ ID NO: 15586 - DNA, 383 bp, Artificial Sequence; identical to SEQ ID NO: 8653
  Synthetic polypeptide

SEQ ID NO: 15587 - DNA, 155 bp, Artificial Sequence; identical to SEQ ID NO: 8654
  Synthetic polypeptide

SEQ ID NO: 15588 - DNA, 118 bp, Artificial Sequence; identical to SEQ ID NO: 8655
  Synthetic polypeptide

SEQ ID NO: 15589 - DNA, 193 bp, Artificial Sequence; identical to SEQ ID NO: 8656
  Synthetic polypeptide

SEQ ID NO: 15590 - DNA, 103 bp, Artificial Sequence; identical to SEQ ID NO: 8657
  Synthetic polypeptide

SEQ ID NO: 15591 - DNA, 230 bp, Artificial Sequence; identical to SEQ ID NO: 8658
  Synthetic polypeptide

SEQ ID NO: 15592 - DNA, 279 bp, Artificial Sequence; identical to SEQ ID NO: 8659
  Synthetic polypeptide

SEQ ID NO: 15593 - DNA, 4550 bp, Artificial Sequence
  Synthetic polypeptide
atagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 15594 - DNA, 3641 bp, Artificial Sequence
  Synthetic polypeptide
atagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggtccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggactctttggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataa

SEQ ID NO: 15595 - DNA, 4230 bp, Artificial Sequence
  Synthetic polypeptide
gcagtggctcacgcctataatcctaatattttaggaggctgagatgagaggatcactgaagaccagagtttgagaccagcctggccaacatagtgagaccctgcgtcttaaaaaaaaaaaaaaaaaaaaggtgctactacattccaagaatatcagaaaactggggaactctcaacatccgatcacatatttcccctcactccaggccttgtttatagtatcccttttgatcacattgttctgcattcaggacaaagacctccagagctccctaaatctacagaaatccatgagcaaaaacgccactgcaacaccacacgccattctaagccaactgacaagcctacaggcaactccaaaactatagaccacaaaagctctacagataatcatgaggctcctcccacttctgaagaaaactccagcaaccaagggaaagacccaatgatccggaaccagcgctctgttgatcctgctgactccactaccacacataaagaatccgctggaaaaaaacatataacgccagcacccaagagcaaaataaactgtcgtaagtccacaacaggcaaatcaacggtaacaagaaaatcagataaaactggaagacctttggaaaagtccatgagtactttggataagacaagtaccagctcacataagactacaacttccttccacaactcaggcaattcacagaccaagcaaaaaagcacatcttttccagaaaaaatcacagcagcctcaaaaacaacatacaagaccacaggaaccccagaagagtcagaaaaaactgaagattccagaacaacagttgcctcagacaagctcctgacaaaaactacaaaaaacatacaagagaccatatcagccaatgagctcacacaatctctagcagagcctacagaacatggaggaaggacagccaatgagaacaacacaccatccccagcagagcctacagaaaatagagaaaggacagccaatgagaacaccacactatccccagcagagcctatagaaaatagagaaaggacagccaatgagaacaccgcaccattcccagcagggcctacagaaaatagagaaatgacagccaatgagaataccacactattcccagcagagcctacagaacatggagaaaggacagccaatgagaacaccacaccatccccagcagagcctacagaacatggagaaaggacagccaatgagaacactacaccatccccagcagagcctacagaacatggagaaaggaccccatttgccaatgacaaaaccacatcatcctcagcagagtctacagaacatggagaaaggaccccactggccaacgagaacaccacaccatccccagcagagcctacagaaaatagagaaaggacagccaatgagaacaccacaccatccccagcagggcctacagaaaacagagaaacgacagccaacgagaagaccacactatccccagtagagcctacagaaaatagagaaacaacagccaatgagaagaccacaccatccccagcagagcctacagaaaatggacaaaggaccccatttgccaatgagaaaaccacatcatcctcagcagagcctacagaacacggagaaaggaccccactggccaatgagaacaccacaccatccccagcagagcctacagaaaatagagaaaggacagccaatgagaagaccacaccatccccagcagagcctacagaaaatggagacaggactcctttggccaatgagaagaccacgccatctctagcagagcctacagaaaatggacaaaggaccccatttgccaatgagaagaccacatcatcctcagcagagcctacagaacacgaagaaaggactccactggccaatgagaacaccacaccatccccggcagagcctacagaaaatagagaaaggacagccaatgagaacaccacaccatccccagcagggcctacagaaaatagagaaatgacagccaacgagaagaccacactattcccagcagagcctacagaaaatagagaaaggacagccaatgagaagaccacatcatccccagcagagcctacagaaaatggacaaaggaccccatttgccaatgagaaaaccacatcatcctcagcagagcctacagaacacggagaaaggaccccactggccaatgagaacaccacactatccccagcagagcctacagaaaatagagaaaggacagccaatgagaagaccacaccattcccagcagagcctacagaaaatagagaaaggacagccaatgagaacaccacaccatccccagcacagcctacagaaaatggagacaggactccattggccaatgagaagaccacaccatctctagcagagcctacagaaaatggaaaaaggaccccatttgccaatgagaagaccacatcatcctcagcagagcctacagaacacgcagaaaggactccactggccaatgagaacaccacatcatccccagcagagcctacagaaaatagagaaaggacagccaatgagaagaccacacaattcccagcagagcctacagaaaatagagaaagcacagccaatgagaagaccacaccattcccagcagagcctacagaaaatagagaatggacagccaatgagaacaccacactatccccagcagagcctacagaacatgaagaaatgaccccattggccaatgagaagaccacactatccccagcagagcctacagaaaatggagaaaggaccccatttaccaatgagaagaccacaccatcctcagcagagcctacagaacatggagaaaggaccccactggccaatgagatcaccacaccatcccgagcagagcctacagaacatggagaaaggatagccaatgagaaggccacaccatccccagcaaagcctacagaacatggagaaacgacagtcaatgaggacaccacaccatcctcagcagagcctacagaaaatggagaaaggaccccactggccaatgagaacaccacaacatccccaacagagtctacagaacatggagaaaggacagccaatgagaagaccacaccatccccagcagagcctacagaacatggagaaaggacaccatcagccaatgagaagaccataccatctccagcaaagcctacagaacacgaagaaatgaccccatcggccaatgagaacaccacaccatccccagtaaagcctacagaacatggagaaaagactacattggccaatgagaagatcacactatccccagaagggcctacagaacatggagcaaaaactacgtcggccaatgagaagatcacaccatccctagcaaagcctacagaacatggagaaaggaccacatcacccaatgacaagatcacctcatctgcagcagagtctacagaacatagagatagggctacatcagccaatgtgatcacaccagccccagcagagcctataaaacatgcaaaaaggaccacattggcccatgagaagatgacacaagtcacagaaaagtccacagaacacccagaaaagaccacgtcaaccacagagaaaaccacaagaaccccagaaaagcctacgctatactcagagaagaccatatgcaccaaagggaaaaacacaccagtcccagaaaagcctacagaaaacctggggaacaccacactgaccactgagaccataaaagccccagtaaagtccacagaaaacccagaaaaaacagcagcagtcacaaagactataaaaccttcagtcaaggtcacaggagacaaatctctcactactacctcttctcatctaaataaaactgaagttactcatcaggtgcccactggttctttcaccctcattacatctagaacgaagctgagttctatcacatcagaagccacaggaaacgagagccatccatacctcaataaagatggctcacagaaaggtatccacgctggacagatgggagagaatgattcattccctgcatgggccatagttattgtggtcctggtggctgtgattctcctcctggtgttccttggcctgatcttcttggtctcctatatgatgcggacacgccgcacactaacccagaacacccagtacaatgatgcagaggatgagggtggccccaattcctacccggtctacctgatggagcagcagaatcttggcatgggccagatcccttccccacggtga

SEQ ID NO: 15596 - DNA, 1739 bp, Artificial Sequence; identical to SEQ ID NO: 13222
  Synthetic polypeptide

SEQ ID NO: 15597 - DNA, 1392 bp, Artificial Sequence; identical to SEQ ID NO: 6782
  Synthetic polypeptide

SEQ ID NO: 15598 - DNA, 933 bp, Artificial Sequence; identical to SEQ ID NO: 6783
  Synthetic polypeptide

SEQ ID NO: 15599 - DNA, 981 bp, Artificial Sequence; identical to SEQ ID NO: 6784
  Synthetic polypeptide

SEQ ID NO: 15600 - DNA, 379 bp, Artificial Sequence; identical to SEQ ID NO: 9067
  Synthetic polypeptide

SEQ ID NO: 15601 - DNA, 401 bp, Artificial Sequence
  Synthetic polypeptide
gagttaaacttctaattaatatatataattctgtatataaagtgcaccaaaaagatgtgttttatgagaaaaattataagaaaggcacaaatatgtgttatttattgagaaaaaggaataattttaaggttatttcaaatatggatttaggaaggaaacagaaacaacatccaaaggaaccagcaagtatgacagagagagagagacagagatgaagacagtcatgggaatgaagatgcatttttggccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactga

SEQ ID NO: 15602 - DNA, 306 bp, Artificial Sequence; identical to SEQ ID NO: 8575
  Synthetic polypeptide

SEQ ID NO: 15603 - DNA, 784 bp, Artificial Sequence; identical to SEQ ID NO: 6798
  Synthetic polypeptide

SEQ ID NO: 15604 - DNA, 118 bp, Artificial Sequence; identical to SEQ ID NO: 13255
  Synthetic polypeptide

SEQ ID NO: 15605 - DNA, 625 bp, Artificial Sequence; identical to SEQ ID NO: 6804
  Synthetic polypeptide

SEQ ID NO: 15606 - DNA, 598 bp, Artificial Sequence; identical to SEQ ID NO: 6805
  Synthetic polypeptide

SEQ ID NO: 15607 - DNA, 1242 bp, Artificial Sequence; identical to SEQ ID NO: 13513
  Synthetic polypeptide

SEQ ID NO: 15608 - DNA, 3134 bp, Artificial Sequence
  Synthetic polypeptide
gaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 15609 - DNA, 3338 bp, Artificial Sequence
  Synthetic polypeptide
gaggaacgcagcctgaatgatacatcaaattacagaatggcttgcaggcacttctgatttcagacctaagtaatatggaaggtaaaacaggaaatacaacagatgatgaagaagaagaggaggtggaggaagaagaagaagatgatgatgaagattctggagctgaaatagaagatgacgatgaagagggttttgatgatgaagatgagtttgatgatgaacatgatgatgatcttgatactgaggataatgaattggaagaattagaagagagagcagaagctagaaaaaaaactactgaaaaacagcaattgcagagcctgtttttgctgtggtcaaagctgactgatagactgtggtttaagtcaacttattcaaaaatgtcttcaaccctgctggtcgagacaagaaatctttatggggtagttggagctgaaagcaggtctgcacctgttcagcatttggcaggatggcaagcggaggagcagcagggtgaaactgacacagttctgtctgcagcggctctttgtgttggagttgggagtttcgctgatccagatgacctgccggggctggcacactttttggagcacatggtattcatgggtagtttgaaatatccagatgagaatggatttgatgccttcctgaagaagcatgggggtagtgataatgcctcaactgattgtgaacgcactgtctttcagtttgatgtccagaggaagtacttcaaggaagctcttgatagatgggcgcagttcttcatccacccactaatgatcagagatgcaattgaccgtgaagttgaagctgttgatagtgaatatcaacttgcaaggccttctgatgcaaacagaaaggaaatgttgtttggaagccttgctagacctggacatcctatgggaaaatttttttggggaaatgctgagacgctcaagcatgagccaagaaagaataatattgatacacatgctagattgagagaattctggatgcgttactactcttctcattacatgactttagtggttcaatccaaagaaacactggatactttggaaaagtgggtgactgaaatcttctctcagataccaaacaatgggttacccagaccaaactttggccatttaacggatccatttgacacaccagcatttaacaaactttatagagttgttccaatcagaaaaattcatgctctgaccatcacatgggcacttcctcctcaacagcaacattacagggtgaagccacttcattatatatcctggctggttggacatgaaggcaaaggcagcattctttctttccttaggaaaaaatgctgggctcttgcactgtttggtggaaatggtgagacaggatttgagcaaaattctacttattcagtgttcagcatttctattacattgactgatgagggttatgaacatttttatgaggttgcttacactgtctttcagtatttaaaaatgctgcagaagctaggcccagaaaaaagaatttttgaagagattcggaaaattgaggataatgaatttcattaccaagaacagacagatccagttgagtatgtggaaaacatgtgtgagaacatgcagctgtacccattgcaggacattctcactggagatcagcttctttttgaatacaagccagaagtcattggtgaagccttgaatcagctagttcctcaaaaagcaaatcttgttttactgtctggtgctaatgagggaaaatgtgacctcaaggagaaatggtttggaactcaatatagtatagaagatattgaaaactcttgggctgaactgtggaatagtaatttcgaattaaatccagatcttcatcttccagctgaaaacaagtacatagccacggactttacgttgaaggctttcgattgcccggaaacagaatacccagttaaaattgtgaatactccacaaggttgcctgtggtataagaaagacaacaaattcaaaatccccaaagcatatatacgtttccatctaatttcaccgttgatacagaaatctgcagcaaatgtggtcctctttgatatctttgtcaatatccttacgcataaccttgcggaaccagcttatgaagcagatgtggcacagctggagtataaactggtagctggagaacatggtttaattattcgagtgaaaggatttaaccacaaactacctctactgtttcagctcattattgactacttagctgagttcaattccacaccagctgtctttacaatgataactgagcagttgaagaagacctactttaacatcctcatcaagcccgagactttggccaaagatgtacggcttttaatcttggaatatgcccgttggtctatgattgacaagtaccaggctttgatggacggcctttcccttgagtctctgctgagcttcgtcaaagaattcaaatcccagctctttgtggagggcctggtacaagggaatgtcacaagcacagaatctatggatttcctgaaatatgttgttgacaaactaaacttcaagcctctggagcaggagatgcctgtgcagttccaggtggtagagctgcccagtggccaccatctatgcaaagtgaaagctctgaacaagggtgatgccaactctgaagtcactgtgtactaccagtcaggtaccaggagtctaagagaatatacgcttatggagctgcttgtgatgcacatggaagaaccttgttttgacttccttcgaaccaagcagacccttgggtaccatgtctaccctacctgtaggaacacatccgggattctaggattttctgtcactgtggggactcaggcaaccaaatacaattctgaagttgttgataagaagatagaagagtttctttctagctttgaggagaagattgagaacctcactgaagaggcattcaacacccaggtcacagctctcatcaagctgaaggagtgtgaggatacccaccttggggaggaggtggataggaactggaatgaagtggttacacagcagtacctctttgaccgccttgcccacgagattgaagcactgaagtcattctcaaaatcagacctggtcaactggttcaaggcccatagagggccaggaagtaaaatgctcagcgttcatgttgttggatatgggaagtatgaactggaagaggatggtaccccttctagtgaggattcaaattcttcttgtgaagtgatgcagctgacctacctgccaacctctcctctgctggcagattgtatcatccccattactgatatcagggctttcacaacaacactcaaccttctcccctaccataaaatagtcaaataa

SEQ ID NO: 15610 - DNA, 809 bp, Artificial Sequence; identical to SEQ ID NO: 8586
  Synthetic polypeptide

SEQ ID NO: 15611 - DNA, 809 bp, Artificial Sequence; identical to SEQ ID NO: 8587
  Synthetic polypeptide

SEQ ID NO: 15612 - DNA, 327 bp, Artificial Sequence; identical to SEQ ID NO: 13380
  Synthetic polypeptide

SEQ ID NO: 15613 - DNA, 724 bp, Artificial Sequence; identical to SEQ ID NO: 8796
  Synthetic polypeptide

SEQ ID NO: 15614 - DNA, 75 bp, Artificial Sequence; identical to SEQ ID NO: 8797
  Synthetic polypeptide

SEQ ID NO: 15615 - DNA, 961 bp, Artificial Sequence; identical to SEQ ID NO: 6722
  Synthetic polypeptide

SEQ ID NO: 15616 - DNA, 841 bp, Artificial Sequence
  Synthetic polypeptide
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacagggccagcagtttcatcatcacagggtccctgcctcagggactagggataaagacggcttcccaggaccccctaggtaccgctctgctgctgacagcgtccagagctctaccagaaacgctggcccagccatggctggcccccaccactggcaggccaagggaggtcaggtaccccgcctgcttccggatcccggcagcccaagactggcccaaaatgcccgccccatgaccgatggcagggccaccgaggagcatccgagtcccttcggaatcccatactccaaactgtctcagtcgaagcacctaaaggccaggacgggcggtagccagtgggcctcatcggattctaaacggagggctcaagccccccgggaccgcaaagacccctag

SEQ ID NO: 15617 - DNA, 572 bp, Artificial Sequence
  Synthetic polypeptide
aaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgacagccactcaggcagctccggccgtggccctggcccccgacggccctcagtggcttcctctgtgtcagaggagtacttcgaggtgagagagcactcagtccctctccggaggcgccactcagagcaagtggccaacgggccaaccccaccaccgcgccggcagctgagtgccccccatataacccgagggacctttgttggaccccagggtggctccccatgggcccagagtcggggaagagaagaagcagatgcgttgaagaggatgcaggcccagcgctccacagacaaggaggcacaggacaaggtcccagaaccctgggtgccctgcagcctgggttcagtgcccggagcccgtcctacctgggaacaatgcgcggctgatcatgcccggcatgatgatcaggcccatggggagcatc

SEQ ID NO: 15618 - DNA, 809 bp, Artificial Sequence; identical to SEQ ID NO: 8613
  Synthetic polypeptide

SEQ ID NO: 15619 - DNA, 895 bp, Artificial Sequence; identical to SEQ ID NO: 613
  Synthetic polypeptide

SEQ ID NO: 15620 - DNA, 247 bp, Artificial Sequence; identical to SEQ ID NO: 614
  Synthetic polypeptide

SEQ ID NO: 15621 - DNA, 551 bp, Artificial Sequence; identical to SEQ ID NO: 615
  Synthetic polypeptide

SEQ ID NO: 15622 - DNA, 266 bp, Artificial Sequence; identical to SEQ ID NO: 12983
  Synthetic polypeptide

SEQ ID NO: 15623 - DNA, 1530 bp, Artificial Sequence; identical to SEQ ID NO: 7238
  Synthetic polypeptide

SEQ ID NO: 15624 - DNA, 369 bp, Artificial Sequence; identical to SEQ ID NO: 7239
  Synthetic polypeptide

SEQ ID NO: 15625 - DNA, 342 bp, Artificial Sequence; identical to SEQ ID NO: 7240
  Synthetic polypeptide

SEQ ID NO: 15626 - DNA, 1419 bp, Artificial Sequence; identical to SEQ ID NO: 7241
  Synthetic polypeptide

SEQ ID NO: 15627 - DNA, 1732 bp, Artificial Sequence
  Synthetic polypeptide
agggatccccaaccctcgggccatggactggtacgggttcgtggcctgttaagaacgagaccacacagcaggggtgagcaacaggtgaacaagtgaagcttcatctgtatttacagctgctctccattgcttgcattacccccagagctccgcctcctgtcagatcagcagtagcattctcacaggatcacaaaccctcttgcaaactgtgcatgtgagagatctaggttgcacactccttatgagaatctaaagcctaatgatctgtcactgtctctcatcacccctagatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaa

SEQ ID NO: 15628 - DNA, 1596 bp, Artificial Sequence
  Synthetic polypeptide
cctgcacatgtatcctggaacaataaaaaaaaaaaagaaagaaaatgtggtatatgtctaccatggaatactacacagccataaaaaaggatgggatcatgtcttttgcaccaacacggatggaactggaggccattatcctgagtaaaatagaaagtcaaataccacatgttctcacttataagtggaatctaaacagcagatacacaaagattggaataatggacagtggagactacaaaaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtga

SEQ ID NO: 15629 - DNA, 1773 bp, Artificial Sequence
  Synthetic polypeptide
cctgcacatgtatcctggaacaataaaaaaaaaaaagaaagaaaatgtggtatatgtctaccatggaatactacacagccataaaaaaggatgggatcatgtcttttgcaccaacacggatggaactggaggccattatcctgagtaaaatagaaagtcaaataccacatgttctcacttataagtggaatctaaacagcagatacacaaagattggaataatggacagtggagactacaaaaggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtga

SEQ ID NO: 15630 - DNA, 578 bp, Artificial Sequence; identical to SEQ ID NO: 9000
  Synthetic polypeptide

SEQ ID NO: 15631 - DNA, 590 bp, Artificial Sequence; identical to SEQ ID NO: 9001
  Synthetic polypeptide

SEQ ID NO: 15632 - DNA, 130 bp, Artificial Sequence; identical to SEQ ID NO: 9002
  Synthetic polypeptide

SEQ ID NO: 15633 - DNA, 1770 bp, Artificial Sequence
  Synthetic polypeptide
tcagatgttggataatgatattgtagtttttaaaatggctttgttgtttgcagatacatactgaaatgtggatgaagtgataggtcaggaatttgcttcaaggatctgggagaggcagaagcatagatatgaatggctgctagttgatcattgaatctggatgagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgtgagctctaccactggggagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacaggcagtctgggcactgggaaacatagctggagatagctctgtttgccgagattacgtcttgaactgttccatccttaatcctttgttaacactccttaccaagtccacacgactgacgatgacacggaatgcagtctgggccctgtcaaatctctgccgagggaaaaacccacccccagagtttgcaaaggtctctccttgtttgcctgtactgtctcgcctactcttcagcagcgactcggacttgctggcagatgcttgctgggccctttcttatctgtctgatggccccaatgagaagatccaggcagtcatagactccggagtctgccggagattggtagagctgctgatgcacaatgattacaaagtggcttctcctgccctgagagccgtgggtaacatcgtcactggggatgacatccagacccaggtcattcttaactgttcagccctaccttgccttctccacttgttgagcagtcccaaggagtcaatccggaaggaagcttgctggactatttcaaatattactgctggcaacagggctcaaatacaggctgttatagatgcaaatatcttccctgtgttgatcgaaatccttcagaaagcagagtttcgtacaaggaaagaggcagcctgggccatcaccaatgccacatcaggaggaacccctgagcagatcaggtacctggtctcactgggctgcatcaaacccctatgtgacttgctgactgtaatggattcgaagattgtgcaagtggccctcaatggactggagaacatcctgcggcttggagagcaagagggcaagcgcagtggctcaggggtcaatccttattgtggcctcatagaggaagcctatggcttggataaaattgagtttctccagagccacgagaaccaggagatctaccagaaggccttcgacctcattgagcactactttggtgtagaagacgatgatagcagcctggctccccaagtcgatgaaacgcaacagcagttcatcttccagcagcctgaggcccccatggagggcttccagctataa

SEQ ID NO: 15634 - DNA, 720 bp, Artificial Sequence
  Synthetic polypeptide
tcagatgttggataatgatattgtagtttttaaaatggctttgttgtttgcagatacatactgaaatgtggatgaagtgataggtcaggaatttgcttcaaggatctgggagaggcagaagcatagatatgaatggctgctagttgatcattgaatctggatgagaccatggcgagcccagggaaagacaattatcgaatgaagagctataagaacaatgctctaaaccctgaagaaatgagacgaagaagagaggaagagggcattcagctccggaagcagaagcgagagcaacaactttttaaacggagaaatgtggagctgattaatgaagaagctgccatgttcgatagtcttctcatggactcttatgagagtgtgatcacaagagagatggtggagatgctcttttctgatgattctgacctgcagttagcaaccacacagaaattccggaaactgctctccaaagagcctagtcctccaatagatgaagttatcaacactccaagagtggtggatcggttcgtggagtttctgaagaggaatgagaattgtacattacagtttgaagctgcctgggctctaacgaatattgcctctggaacctctcagcagaccaaaattgtcattgaagcaggggctgtccccatttttatagagctgcttaattcagactttgaggatgttcaggaacagtctgggcactgggaaacatag

SEQ ID NO: 15635 - DNA, 177 bp, Artificial Sequence
  Synthetic polypeptide
ggccgggtgcggaggctcacacctgtaatcccagcactttgggaggctgaggcaggcggatcacttgagctagaggaaatgacagagcttgaatctcctaaatgtaaaaggcaggaaaatgagcagctactggatcaaaatcaagaaatccgggcatcacagagaagttgggtttag

SEQ ID NO: 15636 - DNA, 398 bp, Artificial Sequence; identical to SEQ ID NO: 6790
  Synthetic polypeptide

SEQ ID NO: 15637 - DNA, 391 bp, Artificial Sequence; identical to SEQ ID NO: 6791
  Synthetic polypeptide

SEQ ID NO: 15638 - DNA, 473 bp, Artificial Sequence; identical to SEQ ID NO: 6792
  Synthetic polypeptide

SEQ ID NO: 15639 - DNA, 585 bp, Artificial Sequence; identical to SEQ ID NO: 7806
  Synthetic polypeptide

SEQ ID NO: 15640 - DNA, 1443 bp, Artificial Sequence; identical to SEQ ID NO: 6760
  Synthetic polypeptide

SEQ ID NO: 15641 - DNA, 984 bp, Artificial Sequence; identical to SEQ ID NO: 6761
  Synthetic polypeptide

SEQ ID NO: 15642 - DNA, 1032 bp, Artificial Sequence; identical to SEQ ID NO: 6762
  Synthetic polypeptide

SEQ ID NO: 15643 - DNA, 676 bp, Artificial Sequence
  Synthetic polypeptide
aatggaaacaaaaatgtaaacagtagttgataaaagaatagtatcaattaaaaacatactgtgaagtattcaacttcaccagtgatttaaaatagaaatgaaagcaaaataatattttctacagcggagcaaataaaatgaaagataatacataatgttggtgaggacatttttaaagggacacccatatattgcactggtatgtagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaat

SEQ ID NO: 15644 - DNA, 4725 bp, Artificial Sequence
  Synthetic polypeptide
aatggaaacaaaaatgtaaacagtagttgataaaagaatagtatcaattaaaaacatactgtgaagtattcaacttcaccagtgatttaaaatagaaatgaaagcaaaataatattttctacagcggagcaaataaaatgaaagataatacataatgttggtgaggacatttttaaagggacacccatatattgcactggtatgtagccacaaatcatcaaaatgacgaggattttgacagctttcaaagtggtgaggacactgaagactggttttggctttaccaatgtgactgcacaccaaaaatggaaattttcaagacctggcatcaggctcctttctgtcaaggcacagacagcacacattgtcctggaagatggaactaagatgaaaggttactcctttggccatccatcctctgttgctggtgaagtggtttttaatactggcctgggagggtacccagaagctattactgaccctgcctacaaaggacagattctcacaatggccaaccctattattgggaatggtggagctcctgatactactgctctggatgaactgggacttagcaaatatttggagtctaatggaatcaaggtttcaggtttgctggtgctggattatagtaaagactacaaccactggctggctaccaagagtttagggcaatggctacaggaagaaaaggttcctgcaatttatggagtggacacaagaatgctgactaaaataattcgggataagggtaccatgcttgggaagattgaatttgaaggtcagcctgtggattttgtggatccaaataaacagaatttgattgctgaggtttcaaccaaggatgtcaaagtgtacggcaaaggaaaccccacaaaagtggtagctgtagactgtgggattaaaaacaatgtaatccgcctgctagtaaagcgaggagctgaagtgcacttagttccctggaaccatgatttcaccaagatggagtatgatgggattttgatcgcgggaggaccggggaacccagctcttgcagaaccactaattcagaatgtcagaaagattttggagagtgatcgcaaggagccattgtttggaatcagtacaggaaacttaataacaggattggctgctggtgccaaaacctacaagatgtccatggccaacagagggcagaatcagcctgttttgaatatcacaaacaaacaggctttcattactgctcagaatcatggctatgccttggacaacaccctccctgctggctggaaaccactttttgtgaatgtcaacgatcaaacaaatgaggggattatgcatgagagcaaacccttcttcgctgtgcagttccacccagaggtcaccccggggccaatagacactgagtacctgtttgattcctttttctcactgataaagaaaggaaaagctaccaccattacatcagtcttaccgaagccagcactagttgcatctcgggttgaggtttccaaagtccttattctaggatcaggaggtctgtccattggtcaggctggagaatttgattactcaggatctcaagctgtaaaagccatgaaggaagaaaatgtcaaaactgttctgatgaacccaaacattgcatcagtccagaccaatgaggtgggcttaaagcaagcggatactgtctactttcttcccatcacccctcagtttgtcacagaggtcatcaaggcagaacagccagatgggttaattctgggcatgggtggccagacagctctgaactgtggagtggaactattcaagagaggtgtgctcaaggaatatggtgtgaaagtcctgggaacttcagttgagtccattatggctacggaagacaggcagctgttttcagataaactaaatgagatcaatgaaaagattgctccaagttttgcagtggaatcgattgaggatgcactgaaggcagcagacaccattggctacccagtgatgatccgttccgcctatgcactgggtgggttaggctcaggcatctgtcccaacagagagactttgatggacctcagcacaaaggcctttgctatgaccaaccaaattctggtggagaagtcagtgacaggttggaaagaaatagaatatgaagtggttcgagatgctgatgacaattgtgtcactgtctgtaacatggaaaatgttgatgccatgggtgttcacacaggtgactcagttgttgtggctcctgcccagacactctccaatgccgagtttcagatgttgagacgtacttcaatcaatgttgttcgccacttgggcattgtgggtgaatgcaacattcagtttgcccttcatcctacctcaatggaatactgcatcattgaagtgaatgccagactgtcccgaagctctgctctggcctcaaaagccactggctacccattggcattcattgctgcaaagattgccctaggaatcccacttccagaaattaagaacgtcgtatccgggaagacatcagcctgttttgaacctagcctggattacatggtcaccaagattccccgctgggatcttgaccgttttcatggaacatctagccgaattggtagctctatgaaaagtgtaggagaggtcatggctattggtcgtacctttgaggagagtttccagaaagctttacggatgtgccacccatctatagaaggtttcactccccgtctcccaatgaacaaagaatggccatctaatttagatcttagaaaagagttgtctgaaccaagcagcacgcgtatctatgccattgccaaggccattgatgacaacatgtcccttgatgagattgagaagctcacatacattgacaagtggtttttgtataagatgcgtgatattttaaacatggaaaagacactgaaaggcctcaacagtgagtccatgacagaagaaaccctgaaaagggcaaaggagattgggttctcagataagcagatttcaaaatgccttgggctcactgaggcccagacaagggagctgaggttaaagaaaaacatccacccttgggttaaacagattgatacactggctgcagaatacccatcagtaacaaactatctctatgttacctacaatggtcaggagcatgatgtcaattttgatgaccatggaatgatggtgctaggctgtggtccatatcacattggcagcagtgtggaatttgattggtgtgctgtctctagtatccgcacactgcgtcaacttggcaagaagacggtggtggtgaattgcaatcctgagactgtgagcacagactttgatgagtgtgacaaactgtactttgaagagttgtccttggagagaatcctagacatctaccatcaggaggcatgtggtggctgcatcatatcagttggaggccagattccaaacaacctggcagttcctctatacaagaatggtgtcaagatcatgggcacaagccccctgcagatcgacagggctgaggatcgctccatcttctcagctgtcttggatgagctgaaggtggctcaggcaccttggaaagctgttaatactttgaatgaagcactggaatttgcaaagtctgtggactacccctgcttgttgaggccttcctatgttttgagtgggtctgctatgaatgtggtattctctgaggatgagatgaaaaaattcctagaagaggcgactagagtttctcaggagcacccagtggtgctgacaaaatttgttgaaggggcccgagaagtagaaatggacgctgttggcaaagatggaagggttatctctcatgccatctctgaacatgttgaagatgcaggtgtccactcgggagatgccactctgatgctgcccacacaaaccatcagccaaggggccattgaaaaggtgaaggatgctacccggaagattgcaaaggcttttgccatctctggtccattcaacgtccaatttcttgtcaaaggaaatgatgtcttggtgattgagtgtaacttgagagcttctcgatccttcccctttgtttccaagactcttggggttgacttcattgatgtggccaccaaggtgatgattggagagaatgttgatgagaaacatcttccaacattggaccatcccataattcctgctgactatgttgcaattaaggctcccatgttttcctggccccggttgagggatgctgaccccattctgagatgtgagatggcttccactggagaggtggcttgctttggtgaaggtattcatacagccttcctaaaggcaatgctttccacaggatttaagataccccagaaaggcatcctgataggcatccagcaatcattccggccaagattccttggtgtggctgaacaattacacaatgaaggtttcaagctgtttgccacggaagccacatcagactggctcaacgccaacaatgtccctgccaccccagtggcatggccgtctcaagaaggacagaatcccagcctctcttccatcagaaaattgattagagatggcagcattgacctagtgattaaccttcccaacaacaacactaaatttgtccatgataattatgtgattcggaggacagctgttgatagtggaatccctctcctcactaattttcaggtgaccaaactttttgctgaagctgtgcagaaatctcgcaaggtggactccaagagtcttttccactacaggcagtacagtgctggaaaagcagcatag

SEQ ID NO: 15645 - DNA, 14950 bp, Artificial Sequence
  Synthetic polypeptide
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactgtgtgactccgccaggaacttggaatggctgaagactgtgaatgagagtcatgggtctgtggaacgctcatccctgaccctggccacggccatcaaccaaagaggcatctatgtgatccaggcgcccaaaggtggccaaaagatttccccagacacggttctgcacttgatccttcctgagagccctggcagccacgaggagtcacgagagtactctttagaggaggtgaaggagcttttgaacaagttgatgctgatgtctggcaagaaggatcgtaacaacacggaagtggagaggttttcagaggtcttctgcagtgtgcagaggctcagccaggccttcatcgacctgcactctgctgggaatatgctgttcaggacgtggatcgccatggcctactgctcccccaagcagggtgtgtccctccaaatggactttggcttggacctggtgacggagcttaaagaaggtggagatgtcactgagctgctggcagccctctgcaggcagatggagcacttccttgacagctggaagagatttgtgacccagaagcgaatggagcacttttacctgaacttctacacggcagagcagctggtttacctgagcactgagctcaggaagcagcccccgagtgatgccgccctaacgatgctatccttcatcaaaagcaactgcaccctgagggatgtcttaagggcctctgtggggtgtgggagtgaggccgccaggtaccgcatgaggagagtcatggaagagctcccgctgatgctcttatcagagttcagcctggtggacaagctgaggatcatcatggagcagtccatgaggtgccttcctgccttcctgcccgactgcctcgacctagagacccttggccactgtctggctcacctggcagggatgggtgggtctcccgtggagcgttgtctcccgagaggtctgcaggtcggccagcccaacctcgtcgtctgtggccactccgaggtgttgccagccgccctggctgtctacatgcaaaccccaagccagcccctgcccacttacgatgaggtgctgctctgcaccccggcaaccacctttgaggaggtggcactgttgctgcgccgctgcctgaccctgggctccctggggcacaaggtctacagcctgctgttcgcagatcagctgagctacgaggtggcacgccaagcggaggagcttttccacaatctgtgcacgcagcagcaccgagaagactaccagctcgtcatggtctgtgatggggactgggagcactgctacctcccctctgccttcagccagcacaaggtcttcgtcaccccccaggcacccctcgaggccatccaagcctacctggcaggtcactaccgggtcccgaagcagaccctgtcggcggcagccgtgttcaatgaccggctgtgtgttgggatcgtggcctcggagcgagcaggtgttggaaagtctctgtacgtgaagaggttgcacgacaaaatgaagatgcagttaaacgtgaaaaatgtgcctctgaaaacaattcgactgatcgaccctcaggtggatgagagccgagtcctgggcgccctgctgcccttcctggatgcgcagtatcagaaggtccccgtgctctttcacctggacgtgacctcctcagtgcagactggaatttgggtgtttcttttcaagctcctcattttacaatacttaatggatataaatgggaaaatgtggcttcggaacccctgccatttgtatatcgttgaaatcctggaaaggaggacgtcagtgccgtcgaggagctcttcagcgctgcgtacacgtgtaccccagttcagttttcttgacatcttcccaaaagtcacctgcaggcctcccaaagaggtgatagacatggagctgagtgccctgaggagtgacacagagcctgggatggatctgtgggagttctgcagcgaaactttccaaagaccttaccagtatttaagacgattcaatcaaaaccaagacctagacacgtttcagtatcaagaaggctctgtcgaaggcaccccggaggaatgcctccagcatttcctgtttcactgcggggtaataaacccatcctggtcagagcttcggaactttgctcggttcctgaattatcagctcagagattgtgaggcctctctcttctgcaatccgagttttattggcgacacactgaggggcttcaagaagttcgtggtgaccttcatgatctttatggcaagagattttgccacaccatcactccacacctctgaccaaagcccggggaagcacatggtcaccatggatggggttagggaagaagatctagcgcccttctccctccggaagaggtgggagtcggagcctcacccatacgttttcttcaatgacgaccacacaaccatgacattcatcggcttccatctgcagcccaacatcaacggcagtgtcgatgccatcagtcacttgactgggaaggtcatcaagagagacgtcatgaccagggacctgtaccagggcctgctgctccagagggtgcccttcaatgtcgactttgataaactgcccagacacaagaaacttgagaggctctgcctgaccttagggatcccccaggccaccgaccccgacaaaacgtatgagctcacaaccgacaatatgcttaaaatccttgccatcgagatgcggttccggtgtgggatcccggttatcatcatgggagaaactggctgtgggaaaaccaggcttattaaattccttagcgacctgcggcgtggtggtaccaatgctgacaccataaagctggtcaaggtgcacggaggaacaactgcagacatgatctactccagagtcagggaggctgaaaatgtggccttcgccaataaggaccaacatcagttggacaccatcttgttttttgatgaagccaacacaacggaagctataagctgtatcaaagaagtcctgtgtgatcatatggtggatggccagcctctggctgaggactctggcctgcatattatagctgcctgcaatccataccggaagcactctgaggagatgatctgccgtttggagtcagctggtttgggctacagggttagtatggaggagacggccgacaggctgggctccattcctctgaggcagctggtataccgggtccatgctctgcccccgagcctgattcctctggtgtgggactttggacaactgagtgacgttgctgaaaagctctacatccagcagattgtccagagactggttgagtccatcagcctagatgaaaacgggactcgcgtgatcacagaagtcctctgcgcctctcagggtttcatgaggaaaacagaagatgagtgcagctttgtcagcctcagggacgtggagcgctgtgtgaaagttttcaggtggttccacgagcacagcgcgatgctcttagcgcagctgaatgcctttctctccaagtccagcgtcagcaaaaatcacaccgagagagatcccgtcctctggtcgttgatgctggccatcggggtgtgttaccatgcctctttagaaaagaaagactcatatcggaaagccatcgccaggttctttccgaaaccgtatgacgacagcaggctgcttctggatgaaataacacgggcacaggatctttttctggacggcgtacctctgaggaaaaccatcgccaagaacttggccttgaaggagaacgtcttcatgatggtcgtctgcatcgagctgaagattcccctcttcctggtggggaagcccggcagctccaagtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcggccagaagtacgtggacctcggtctggggacccaccgcgtcaaatgtcgggttcaccccaacttccgcctgattgtcattgaagagaaagacgtcgtgtacaaacactttcccatccccctcattaaccggctggagaagcactatctggatatcaacacggtgctggagaaatggcagaagagcatcgtggaggagctctgtgcgtgggtggagaagttcatcaatgtcaaagcacatcatttccagaagaggcacaaatacagcccctctgacgtcttcatcggctaccactcggacgcctgcgcgtctgtggtgctgcaggtcatagagaggcagggtccccgggccttgacggaggaacttcaccagaaggtgtctgaggaggccaaatcgatcctgctgaactgcgctacgcccgatgccgtggtccggctgagcgcctactcgctgggcgggttcgcagcggagtggctgtcgcaggagtactttcacagacagaggcacaactcctttgcagatttccttcaggcacacctgcacacggcagacctggagcgccacgccatcttcacagagatcaccactttctccaggctgctaacaagtcacgactgtgaaattttagaatcagaggtcacaggcagggctccgaaacccacactcctgtggctgcagcagtttgacaccgagtactcattcctcaaagaagtccgaaactgtttaacgaatacagccaaatgtaaaatcctcatttttcagacagattttgaagatggaatccgtagcgcccagctcattgcctcagctaagtattctgttataaatgaaatcaacaaaatacgagaaaatgaggaccgtatcttcgtctatttcatcacaaaactgtcccgggtgggaagaggaacagcctatgtgggcttccacggagggctgtggcagtctgtccacatcgatgacctccggagatccaccctcatggtttctgatgtgaccaggctgcagcatgtcaccatcagccagctgttcgcgcccggagacttgcctgagctgggcttggaacaccgggcggaagacggccatgaggaggcgatggagacggaggccagcacatcaggggaggtggcagaggtggcagaggaggccatggaaacagaaagttctgagaaggtgggaaaggaaacctctgaactcggaggcagtgatgtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacgcctctttcttgcgggtatccaagatgcgcctcagtgtctttttaaagaagcaagaagagagccagtttcaccctctggagtggttggcaagggaagcctgcaaccaggacgctctccaggaggcgggcacattcaggcacaccctctggaagcgggtccaaggtgctgtcacccctctgctggcgagcatgatatcattcatcgacagagacggcaacctagagttactgaccaggccagatactccgccctgggcaagagatctttggatgtttattttcagtgacacgatgcttctgaacattcctcttgtgatgaataatgaaagacataaaggtgagatggcctacatcgtggtgcagaaccacatgaacctttccgagaacgcttccaacaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcctgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccacgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatag

SEQ ID NO: 15646 - DNA, 3979 bp, Artificial Sequence
  Synthetic polypeptide
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcaatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaacaatgtgctgtggaggaagcactggattggagaagggaggaactgttacttctaaagaaagagaaaagatgtgttgatagtctcctgaagatgtgtgggaacgtgaaacatctgatacaagtggactttggagtgcttgcagtaagacactcacaagacctcagcagtaaaagattaaatgacaccgtgacagtgagactgtccacctcctcgaactcgcagagggcaacgcattaccacctgagctcccaggtccaagaaatggctgggaagatagacttgctcagagacagccacatcttccagctcttctggcgggaagccgcagagccgctgagtgagcctaaggaggaccaggaagccgcagagttgctgagtgagcccgaagaagaatcagaaaggcacatccttgagcttgaagaggtgtatgactatttgtatcagccttcttacagaaagttcattaagttgcaccaggatctaaagtcaggagaggtcacccttgcagagattgatgtcatcttcaaggactttgtgaataaatacacggacctggattcagaacttaagatcatgtgcaccgtggaccaccaggaccaaagagattggatcaaggaccgagtcgaacagatcaaggaataccatcacctgcaccaggctgtccacgcagccaaggtcatcttgcaggtcaaagagagcctgggactgaacggtgacttcagtgttctcaacactttactaaattttactgataacttcgacgactttcgccgtgaaacactggaccagatcaaccaggagctcatccaggccaaaaagctgctccaggacatcagcgaggcccggtgcaaggggctgcaggctctgtccctgagaaaggagttcatctgctgggtccgggaggctcttggaggcatcaatgagctgaaggtgtttgtggacctggcctccatctcagcgggggagaatgacattgatgtggaccgggtggcctgcttccatgacgctgtgcagggctacgcatccctgctatttaagctggaccccagcgtggacttcagtgcattcatgaagcatctgaaaaagctgtggaaggctctggataaggaccagtacctgcccaggaaactggtgagtcttattctgtctctaatgcagattttgttgaatagagcattgcttagcaacgttagggcagtgactgtggaaatggtggcacacctgtgtggtaggtttgtacacagccgttttcaatga

SEQ ID NO: 15647 - DNA, 2518 bp, Artificial Sequence
  Synthetic polypeptide
ggccaggcgcggtagctcacacctataatcccagcactttgggaagcccaggcgggtgcatcacctgagttcaggagttcaagaccagcctggccaacatggtgaaaccccgtctctactaaaaatacaaaaattagccagccgtggtggcatgtgcctgtaatcccagctactcgggaggctgtcgcaggagaattgcttgagcctgggaggcggaggttgcagtgagctgagatcgcagtactgcactccagccttggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggcattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccaggtgaacaatctctcctcctgggaaacggattcgggctcacagctgtgttctgccatgacccagctaagggctatgaagcacccgctgggtctcagctcctccgctaactcagagattgggaagtgggcaccctcctccctcgccaagggcaatggcgctgaaatctag

SEQ ID NO: 15648 - DNA, 1352 bp, Artificial Sequence; identical to SEQ ID NO: 8674
  Synthetic polypeptide

SEQ ID NO: 15649 - DNA, 1147 bp, Artificial Sequence
  Synthetic polypeptide
ggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtga

SEQ ID NO: 15650 - DNA, 526 bp, Artificial Sequence; identical to SEQ ID NO: 10237
  Synthetic polypeptide

SEQ ID NO: 15651 - DNA, 1314 bp, Artificial Sequence; identical to SEQ ID NO: 10238
  Synthetic polypeptide

SEQ ID NO: 15652 - DNA, 1218 bp, Artificial Sequence; identical to SEQ ID NO: 10239
  Synthetic polypeptide

SEQ ID NO: 15653 - DNA, 1197 bp, Artificial Sequence; identical to SEQ ID NO: 10240
  Synthetic polypeptide

SEQ ID NO: 15654 - DNA, 919 bp, Artificial Sequence; identical to SEQ ID NO: 10241
  Synthetic polypeptide

SEQ ID NO: 15655 - DNA, 629 bp, Artificial Sequence; identical to SEQ ID NO: 10242
  Synthetic polypeptide

SEQ ID NO: 15656 - DNA, 4170 bp, Artificial Sequence
  Synthetic polypeptide
ctaacaattgctgtctgcggttagactccagtcagtcctggctttggaaagcttcctcccgtctatacaacgaagaggtcggaccagcgctaaggtcatccagagactgcttcccagggtcacctggacctcacgcagctcatcggtgtcccgctgccctcgtccgtatcctttgtcacaggctatggtggcttcccggcctacagtttcgggcctggtgccaatgttggccgcccagccaggactctcatcccatccaccttcttcagggacttcgccatcagcgtcgtggtgaagcccagcagcacccgtggtggcgtgctcttcgccatcactgacgccttccagaaggtcatctacctgggcctgcggctctcaggtgtggaggacggccaccagcggatcatcctctactacacggagccaggctcccatgtgtcccaagaggctgctgccttctcggtgcctgtgatgacccacaggtggaaccgcttcgccatgattgtccagggtgaggaagtgaccctcctcgtgaactgtgaggagcacagccgcatccccttccagcggtcctcccaggctttggcttttgagtccagcgctggaatcttcatgggcaatgcaggagctacagggctcgagagattcactggctccctccagcagctcaccgtgcaccccgaccccaggactcccgaggagctgtgtgaccctgaagagtcctcggcatctggagagaccagtgggctgcaggaggcagacggagtagctgagatcttagaagccgtcacctacactcaagcctcgcccaaagaagcaaaagttgaacccataaacacacctccaactccatcctccccctttgaagacatggaactttctggtgaacctgtacccgaggggaccctggaaaccaccaacatgagcatcatccagcacagcagccccaaacaagggtctggtgagatcctgaatgacacactggagggggttcattctgtggatggtgaccccattactgacagcggctcaggggctggggccttccttgacattgctgaagaaaagaatttagcagcaacagcagcggggctggccgaggtgcccatcagcactgctggagaagcagaggccagcagtgtgcccaccgggggaccaaccctctctatgtccacggagaacccagaggaaggggtcactccaggtccagataatgaagagcgtttagcagcaacagcagcaggggaggccgaggcactcgccagcatgcctggggaagtggaggccagtggtgtggcccccggggagctggacctctccatgtccgcccagagcctcggggaagaggccactgtgggtccaagcagtgaagacagtttaacaacagctgcagctgcaaccgaagtgtccctcagtacttttgaggatgaggaagccagtggggtccccacagatggcctggctcccctcacagccaccatggcccctgagcgggcagtcacttctggtcctggtgatgaagaagacttggcagcagccacaacagaggagcccctcatcacagctgggggtgaagagtccggcagccctccccctgatgggccaccgctgcccctgcccacagtggctcctgaaagatggatcactccagctcaaagagaacatgtgggaatgaaaggacaggctgggcccaaaggagaaaagggtgatgctggggaggagcttcctggccctcctgaaccttctgggcctgttggacccacggcaggagcagaagcagagggctctggcctaggctggggctcggacgtcggctctggctctggtgacctggtgggcagtgagcagctgctgagaggtcctccaggacccccagggccacctggcttacctgggattccaggaaaaccaggaactgatgttttcatgggaccccctggatctcctggagaggatggacctgctggtgaacctgggcccccgggccctgagggacagcctggagttgatggagccaccggccttcccgggatgaaaggggagaagggagcaagagggcctaatggctcagttggtgaaaagggtgaccctggcaacagaggcttacctggacccccggggaaaaagggacaagctggccctcctggggtcatgggacccccagggcctcctggaccccctgggcccccaggccctggatgcacaatgggacttggattcgaggataccgaaggctctggaagcacccagctattgaatgaacccaaactctccagaccaacggctgcaattggtctcaaaggagagaaaggagaccggggacccaagggagaaagggggatggatggagccagtattgtgggaccccctgggccgagagggccacctgggcacatcaaggtcttgtctaattccttgatcaatatcacccatggattcatgaatttctcggacattcctgagctggtggggcctccggggccggacgggttgcctgggctgccaggatttccaggtcctagaggaccaaaaggtgacactggtttacctggctttccaggactaaaaggagaacagggcgagaagggagagccgggtgccatcctgacagaggacattcctctggaaaggctgatggggaaaaagggtgaacctggaatgcatggagccccaggaccaatggggcccaaaggaccaccaggacataaaggagaatttggccttcccgggcgacctggtcgcccaggactgaatggcctcaagggtaccaaaggagatccaggggtcattatgcagggcccacctggcttacctggccctccaggcccccctgggccacctggagctgtgattaacatcaaaggagccattttcccaatacccgtccgaccacactgcaaaatgccagttgatactgctcatcctgggagtccagagctcatcacttttcacggtgttaaaggagagaaaggatcctggggtcttcctggctcaaagggagaaaaaggcgaccagggagcccagggaccaccaggtcctccacttgatctagcttacctgagacactttctgaacaacttgaagggggagaatggagacaaggggttcaaaggtgaaaaaggagaaaaaggagacattaatggcagcttccttatgtctgggcctccaggcctgcccggaaatccaggcccggctggccaaaaaggggagacagtcgttgggccccaaggacccccaggtgctcctggtctgcctgggccacctggctttggaagacctggtgatcctgggccaccggggcccccggggccaccaggacctccagctatcctgggagcagctgtggcccttccaggtccccctggccctccaggacagccagggcttcccggatccagaaacctggtcacagcattcagcaacatggatgacatgctgcagaaagcgcatttggttatagaaggaacattcatctacctgagggacagcactgagtttttcattcgtgttagagatggctggaaaaaattacagctgggagaactgatccccattcctgccgacagccctccaccccctgcgctttccagcaacccacatcagcttctgcctccaccaaaccctatttcaagtgccaattatgagaagcctgctctgcatttggctgctctgaacatgccattttctggggacattcgagctgattttcagtgcttcaagcaggccagagctgcaggactgttgtccacctaccgagcattcttatcttcccatttgcaagatctgtccaccattgtgaggaaagcagagagatacagccttcccatagtgaacctcaagggccaagtactttttaataattgggactcaattttttctggccacggaggtcagttcaatatgcatattccaatatactcctttgatggtcgagacataatgacagatccttcttggccccagaaagtcatttggcatggctccagcccccatggcgtccgccttgtggataactactgtgaagcatggcgaaccgcggacacagcggtcacgggacttgcctccccgctgagcacggggaagattctggaccagaaagcatacagctgtgctaatcggctaattgtcctatgtatcgaaaacagtttcatgacagacgctaggaagtaa

SEQ ID NO: 15657 - DNA, 74 bp, Artificial Sequence; identical to SEQ ID NO: 7010
  Synthetic polypeptide

SEQ ID NO: 15658 - DNA, 1488 bp, Artificial Sequence
  Synthetic polypeptide
gaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagcaactcccaaggattccaacagtctcaaagcaagaccaagatccagatcttactctagcacctccatagaagaggccatgaaaaggggcgaggaccctcccaccccgccacctcggccacagaaaacccattccagagcctcctccttggatctgaataaagtcttccagcccagtgtgccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtga

SEQ ID NO: 15659 - DNA, 1305 bp, Artificial Sequence
  Synthetic polypeptide
gaagcaggcgtggcataatggcaatagcttttgattggaagcagaaggtgtgtgggtttctgtgactagctgtaggactttgggcaggccattgaacatctctgaaccacgattacctcttctctcttaaaatggagtaacagtatcctagaggggtattagaagattaagtgagaatcaccttatgaagctaggcagccccttgtccagcccgagggatcctcatcagggggcccaggaaccaagccccttcggcatcaggcttcccttatccggtccttttcagtggagagggaactacaggataacagcagttaccccgacgaaccctggaggataacagaagaacagcgcgagtactatgtcaatcagttccgatcccttcagccagacccaagctctttcatttcaggttctgtggccaagaacttcttcaccaaatcaaagctttccattccagaactctcctatatatgggagcttagtgatgctgactgtgatggagccctgaccctgcctgagttctgtgctgcgtttcatctcattgtggctcggaagaacggctacccattgcctgagggcctccctccaactctgcagccagaatacctgcaggcagcttttcctaagcccaaatgggactgtcaattatttgattcttattctgagtcactgccggcaaatcaacaacctcgtgacttgaatcggatggagaagacatctgttaaagacatggctgaccttcctgtccctaaccaggatgtaactagtgatgacaaacaagctttgaaaagtactatcaatgaagccttaccaaaggacgtgtctgaggatccagctaccaagtcaggattgttacccccaccacctgcgctccctccaagaccttgtccatcacagtctgaacaagtgtcggaggccgagttactcccacagctgagcagagccccatcccaggctgcagaaagtagtccagcaaagaaggatgtactgtattctcagccaccatcaaagcccattcgtaggaaattcagaccagaaaaccaagctacagaaaaccaagagccttccactgctgcaagtgggccagcttctgcggcaaccatgaaaccgcatccaacagtccaaaagcagtcttccaaacagaagaaggccattcaaactgctatccgcaaaaataaagaggcaaacgcagtgctggctcggctgaacagtgagctccagcagcagctcaaggaggttcatcaagaacgaattgcattggaaaaccaattggaacaacttcgtccggtcactgtgttgtga

SEQ ID NO: 15660 - DNA, 1446 bp, Artificial Sequence; identical to SEQ ID NO: 8572
  Synthetic polypeptide

SEQ ID NO: 15661 - DNA, 104 bp, Artificial Sequence; identical to SEQ ID NO: 8573
  Synthetic polypeptide

SEQ ID NO: 15662 - DNA, 489 bp, Artificial Sequence; identical to SEQ ID NO: 8574
  Synthetic polypeptide

SEQ ID NO: 15663 - DNA, 294 bp, Artificial Sequence; identical to SEQ ID NO: 13689
  Synthetic polypeptide

SEQ ID NO: 15664 - DNA, 104 bp, Artificial Sequence; identical to SEQ ID NO: 13690
  Synthetic polypeptide

SEQ ID NO: 15665 - DNA, 750 bp, Artificial Sequence
  Synthetic polypeptide
ccgagcgcagtggctcacacctgtaatcccagaactttgggaggccgagatacatcagcccacagcaaggcgggctccagcagcccggagccatgggcccggccctcctgcactccccaggaagggggctgcccacggcccaaggagcgtgagtcaccacccccttcggccctgcagccggtccagctgcctcgcctggccttgtctccaccacccccagcccctccactgccacccccaccgccactggcccaagtggcaccctcaccccctagccccccaccccctcctcggcctccacccacgctctcggcctcagacccctccctggacttcctgcgggcccagcaggagactgccaacgccatccgggagctggccggcacccttcgacagggactggccaaactgagcgaggccctcagcgctctgctgccccttctgccaggaaccccagttgactccctgcctccacctctgcccccacccccacccccaccgccacctcccaggcctgtcctgcccccaccggcccccaaggtggagatcaccccagagcccgtgtccgtggtggctgctgtggtggacggggcagtggtggcagccaggggagtgatcattgccccaaggagcgaggagggggcaccccggccccccccagccccgctccctccgcacgactcccccccacacaagcggagaaaaggtttccctacacggaaaaggcgcggccgatggaaatctccgtga

SEQ ID NO: 15666 - DNA, 2506 bp, Artificial Sequence
  Synthetic polypeptide
gagacagcctcattcagacaagctctggagttggtcaaagcttggttcaaatcctgactccaccacttattaacgagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcaataaaatctacgtggttgacttgagtaatgagcgagccatgtcactcaccatcgagccacggcccgtcaaacagagccgcaagtttgtccctggctgtttcgtgtgtctagaatctcggacctgcagtagcaacctcaccctgacatctggctccaaacacaaaatctccttcctttgtgatgatctgacacgtctgtggatgaatgtggaaaaaaccataagctgcacagaccaccggtactgccaaaggaaatcctactcactccaggtgcccagtgacatcctccacctgcctgtggagctgcatgacttctcctggaagctgctggtgcccaaggacaggctcagcctggtgctggtgccagcccagaagctgcagcagcatacacacgagaagccctgcaacaccagcttcagctacctcgtggccagtgccatacccagccaggacctgtacttcggctccttctgcccgggaggctctatcaagcagatccaggtgaagcagaacatctcggtgacccttcgcacctttgcccccagcttccaacaagaggcctccaggcagggtctgacggtgtcctttataccttatttcaaagaggaaggcgttttcacggtgacccctgacacaaaaagcaaggtctacctgaggacccccaactgggaccggggcctgccatccctcacctctgtgtcctggaacatcagcgtgcccagagaccaggtggcctgcctgactttctttaaggagcggagcggcgtggtctgccagacagggcgcgcattcatgatcatccaggagcagcggacccgggctgaggagatcttcagcctggacgaggatgtgctccccaagccaagcttccaccatcacagcttctgggtcaacatctctaactgcagccccacgagcggcaagcagctagacctgctcttctcggtgacacttaccccaaggactgtggacttgactgtcatcctcatcgcagcggtgggaggtggagtcttactgctgtctgccctcgggctcatcatttgctgtgtgaaaaagaagaaaaagaagacaaacaagggccccgctgtgggtatctacaatgacaacatcaatactgagatgccgaggcagccaaaaaagtttcagaaagggcgaaaggacaatgactcccatgtgtatgcagtcatcgaggacaccatggtatatgggcatctgctacaggattccagcggctccttcctgcagccagaggtggacacctaccggccgttccagggcaccatgggggtctgtcctccctccccacccaccatatgctccagggccccaactgcaaagttggccactgaggagccacctcctcgctcccctcctgagtctgagagtgaaccgtacaccttctcccatcccaacaatggggatgtaagcagcaaggacacagacattcccttactgaacactcaggagcccatggagccagcagaataa

SEQ ID NO: 15667 - DNA, 1027 bp, Artificial Sequence
  Synthetic polypeptide
gagacagcctcattcagacaagctctggagttggtcaaagcttggttcaaatcctgactccaccacttattaacgagaagcttttgagattgctctgccacgagaaagcaacattacagttctcataaagctggggaccccgactctgctggcaaaaccctgttacatcgtcatttctaaaagacatataaccatgttgtccatcaagtctggagaaagaatagtctttacctttagctgccagagtcctgagaatcactttgtcatagagatccagaaaaatattgactgtatgtcaggcccatgtccttttggggaggttcagcttcagccctcgacatcgttgttgcctaccctcaacagaactttcatctgggatgtcaaagctcataagagcatcggtttagagctgcagttttccatccctcgcctgaggcagatcggtccgggtgagagctgcccagacggagtcactcactccatcagcggccgaatcgatgccaccgtggtcaggatcggaaccttctgcagcaatggcactgtgtcccggatcaagatgcaagaaggagtgaaaatggccttacacctcccatggttccaccccagaaatgtctccggcttcagcattgcaaaccgctcatctataaaacgtctgtgcatcatcgagtctgtgtttgagggtgaaggctcagcaaccctgatgtctgccaactacccagaaggcttccctgaggatgagctcatgacgtggcagtttgtcgttcctgcacacctgcgggccagcgtctccttcctcaacttcaacctctccaactgtgagaggaaggaggagcgggttgaatactacatcccgggctccaccaccaaccccgaggtgttcaagctggaggacaagcagcctgggaacatggcggggaacttcaacctctctctgcaaggctgtgaccaagatgcccaaagtccagggatcctccggctgcagttccaagttttggtccaacatccacaaaatgaaagcagtgagtga

SEQ ID NO: 15668 - DNA, 242 bp, Artificial Sequence
  Synthetic polypeptide
ggccgggcgcggtggctcatgcctgtaatcccagcactttgggaggctgaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaa

SEQ ID NO: 15669 - DNA, 172 bp, Artificial Sequence
  Synthetic polypeptide
ggccgggcgcggtggctcatgcctgtaatcccagcactttgggaggctgaggtcagtttgctgagaacgaaaccaatgaggtcaattttagagagataccttcacatgtgctatcgaaagtatgcatgtattttacgtacaaggttcgctacactaacagctccaccgagat

SEQ ID NO: 15670 - DNA, 2534 bp, Artificial Sequence; identical to SEQ ID NO: 586
  Synthetic polypeptide

SEQ ID NO: 15671 - DNA, 342 bp, Artificial Sequence
  Synthetic polypeptide
aagatggccaaacaggaacagctccagtctacagctcccagcgtgagcaacacagaagacgaatgatttctgcatttccaactgaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatga

SEQ ID NO: 15672 - DNA, 519 bp, Artificial Sequence; identical to SEQ ID NO: 9679
  Synthetic polypeptide

SEQ ID NO: 15673 - DNA, 213 bp, Artificial Sequence; identical to SEQ ID NO: 9680
  Synthetic polypeptide

SEQ ID NO: 15674 - DNA, 117 bp, Artificial Sequence; identical to SEQ ID NO: 13730
  Synthetic polypeptide

SEQ ID NO: 15675 - DNA, 1968 bp, Artificial Sequence
  Synthetic polypeptide
aatagagctccaagaggcagaagtttgtatcaattatgttccttgcttgttgctgagaatctagaacggtgttaattagcacatggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaa

SEQ ID NO: 15676 - DNA, 1331 bp, Artificial Sequence; identical to SEQ ID NO: 550
  Synthetic polypeptide

SEQ ID NO: 15677 - DNA, 1028 bp, Artificial Sequence; identical to SEQ ID NO: 551
  Synthetic polypeptide

SEQ ID NO: 15678 - DNA, 1295 bp, Artificial Sequence; identical to SEQ ID NO: 553
  Synthetic polypeptide

SEQ ID NO: 15679 - DNA, 1322 bp, Artificial Sequence; identical to SEQ ID NO: 554
  Synthetic polypeptide

SEQ ID NO: 15680 - DNA, 1013 bp, Artificial Sequence; identical to SEQ ID NO: 555
  Synthetic polypeptide

SEQ ID NO: 15681 - DNA, 1272 bp, Artificial Sequence
  Synthetic polypeptide
ggctggtcgtggtggttcatgcctgtaatcccagcactttgggaggctgaggcggtggatcacttgaacccaggagttcaagaccagcctggccaacatggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgctattgaatttatggaaacgtttgtatttgctattaaacttcaaaatctacaaactgtaagacttgtatttaagattcaaacccagactcccaggaagaaaaccattggagaatgctcaatgtcactcagaacccttagcacacaggaaatggattactctttggatataacaccaccttcaaaaatttctgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttga

SEQ ID NO: 15682 - DNA, 1080 bp, Artificial Sequence
  Synthetic polypeptide
ggctggtcgtggtggttcatgcctgtaatcccagcactttgggaggctgaggcggtggatcacttgaacccaggagttcaagaccagcctggccaacatggatctgccagagcatcttttggagatcgaaaggtagaactttccagttcatcccagcacggacctagctatgatgtgtataacccattctatatgtatcagcacatttcacctgatttgagtcgacgctttcctccccgttcagaagtgaagagactgtatggatcggtttgtgatttaaggacgaacaaacttcccggttcccctgggctaagcaaatctatgtttgatcttacaaactcatctcagcgattcatccagagacatgattcattgtccagtgtacccagtagttcttcttcaaggaaaaattctcaggggagtaacagaagcctggatacaattactctatcaggagatgaaagggactttgggagactgaatgtgaaattgttttataattcttcagtagaacagatctggatcacagttttacagtgcagagatttaagttggccctctagttatggagacactcctactgtttctataaaaggaatacttacattgcccaaaccagtgcatttcaaatcttcagccaaggaaggttccaacgtttgccatgcagaacttgaattggggacttgttttcaagcagtaaatagcagaattcagttacaaattcttgaggcacggtaccttccaagctcatcaacacctctgactttgagttttttcgtgaaggtgggaatgtttagctcgggagagttgatttataagaaaaagacacgcttactgaaggcctccaatggaagagtcaagtggggagagactatgatttttccacttatacagagtgaaaaagaaattgtttttctcattaagctttacagtcgaagctctgtaagaagaaaacactttgtgggccagatttggataagtgaagacagtaataacattgaagcagtgaaccagtggaaagagacagtaataaatccagaaaaggttgttatcaggtggcacaaattaaatccatcttga

SEQ ID NO: 15683 - DNA, 139 bp, Artificial Sequence; identical to SEQ ID NO: 13085
  Synthetic polypeptide

SEQ ID NO: 15684 - DNA, 511 bp, Artificial Sequence
  Synthetic polypeptide
ggaggaggcggtggaggaagaggtggcggcggtggcggtggtcgtagcggtggcggaggaggcgggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 15685 - DNA, 278 bp, Artificial Sequence
  Synthetic polypeptide
ggaggaggcggtggaggaagaggtggcggcggtggcggtggtcgtagcggtggcggaggaggcgggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtctt

SEQ ID NO: 15686 - DNA, 328 bp, Artificial Sequence
  Synthetic polypeptide
ggaggaggcggtggaggaagaggtggcggcggtggcggtggtcgtagcggtggcggaggaggcgggaggaagataccaactagagataaaaataccagaaacatacccatttaatccccctaagtacaaacaaaatcccgaaatgttcaaacagacagctcgactttgggcacatgtgtatgctggagcaccagtttctagtccagaatacaccaaaaaaatagaaaacctatgtgctatgggctttgataggaatgcagtaatagtggccttgtcttcaaaatcatgggatgtagagactgcaacagaattgcttctgagtaactga

SEQ ID NO: 15687 - DNA, 382 bp, Artificial Sequence
  Synthetic polypeptide
ggaggaggcggtggaggaagaggtggcggcggtggcggtggtcgtagcggtggcggaggaggcgggaggaagataccaactagagataaaaataccagaaacatacccatttaatccccctaaggtccggtttatcactaaaatatggcatcctaatattagttccgtcacaggggctatttgtttggatatcctgaaagatcaatgggcagctgcaatgactctccgcacggtattattgtcattgcaagcactattggcagctgcagagccagatgatccacaggatgctgtagtagcaaatcagaatgcagtaatagtggccttgtcttcaaaatcatgggatgtagagactgcaacagaattgcttctgagtaactga

SEQ ID NO: 15688 - DNA, 2317 bp, Artificial Sequence; identical to SEQ ID NO: 8404
  Synthetic polypeptide

SEQ ID NO: 15689 - DNA, 597 bp, Artificial Sequence; identical to SEQ ID NO: 759
  Synthetic polypeptide

SEQ ID NO: 15690 - DNA, 654 bp, Artificial Sequence; identical to SEQ ID NO: 760
  Synthetic polypeptide

SEQ ID NO: 15691 - DNA, 654 bp, Artificial Sequence; identical to SEQ ID NO: 6998
  Synthetic polypeptide

SEQ ID NO: 15692 - DNA, 651 bp, Artificial Sequence; identical to SEQ ID NO: 6999
  Synthetic polypeptide

SEQ ID NO: 15693 - DNA, 498 bp, Artificial Sequence; identical to SEQ ID NO: 7000
  Synthetic polypeptide

SEQ ID NO: 15694 - DNA, 189 bp, Artificial Sequence; identical to SEQ ID NO: 7001
  Synthetic polypeptide

SEQ ID NO: 15695 - DNA, 718 bp, Artificial Sequence; identical to SEQ ID NO: 821
  Synthetic polypeptide

SEQ ID NO: 15696 - DNA, 112 bp, Artificial Sequence; identical to SEQ ID NO: 7120
  Synthetic polypeptide

SEQ ID NO: 15697 - DNA, 1034 bp, Artificial Sequence
  Synthetic polypeptide
gccggttgcggtggctctcacctgtaatcccagcactttgagaggctgagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttggaagaggatgatgtgttcctactagatgtctgggaccaggtcttcttctggattgggaaacatgccaacgaggaggagaagaaggccgcagcaaccactgcacaggaatacctcaagacccatcccagcgggcgtgaccctgagacccccatcattgtggtgaagcagggacacgagccccccaccttcacaggctggttcctggcttgggatcccttcaagtggagtaacaccaaatcctatgaggacctgaaggcggagcttggcaactctagggactggagccagatcactgctgaggtcacaagccccaaagtggacgtgttcaatgctaacagcaacctcagttctgggcctctgcccatcttccccctggagcagctagtgaacaagcctgtagaggagctccccgagggtgtggaccccagcaggaaggaggaacacctgtccattgaagatttcactcaggcctttgggatgactccagctgccttctctgctctgcctcgatggaagcaacaaaacctcaagaaagaaaaaggactattttga

SEQ ID NO: 15698 - DNA, 482 bp, Artificial Sequence
  Synthetic polypeptide
gccggttgcggtggctctcacctgtaatcccagcactttgagaggctgagggaggcacctcccgaactaacaacttggagaccgggccctccacacggctgttccaggtccagggaactggcgccaacaacaccaaggcctttgaggtcccagcgcgggccaatttcctcaattccaatgatgtctttgtcctcaagacccagtcttgctgctatctatggtgtgggaagggttgtagcggggacgagcgggagatggccaagatggttgctgacaccatctcccggacggagaagcaagtggtggtggaagggcaggagccagccaacttctggatggccctgggtgggaaggccccctatgccaacaccaagagactacaggaagaaaacctggtcatcaccccccggctctttgagtgttccaacaagactgggcgcttcctggccacagagatccctgacttcaatcaggatgacttg

SEQ ID NO: 15699 - DNA, 1151 bp, Artificial Sequence; identical to SEQ ID NO: 13468
  Synthetic polypeptide

SEQ ID NO: 15700 - DNA, 516 bp, Artificial Sequence; identical to SEQ ID NO: 13469
  Synthetic polypeptide

SEQ ID NO: 15701 - DNA, 353 bp, Artificial Sequence; identical to SEQ ID NO: 13470
  Synthetic polypeptide

SEQ ID NO: 15702 - DNA, 1679 bp, Artificial Sequence; identical to SEQ ID NO: 13471
  Synthetic polypeptide

SEQ ID NO: 15703 - DNA, 1916 bp, Artificial Sequence; identical to SEQ ID NO: 13472
  Synthetic polypeptide

SEQ ID NO: 15704 - DNA, 720 bp, Artificial Sequence; identical to SEQ ID NO: 7789
  Synthetic polypeptide

SEQ ID NO: 15705 - DNA, 3133 bp, Artificial Sequence; identical to SEQ ID NO: 7183
  Synthetic polypeptide

SEQ ID NO: 15706 - DNA, 369 bp, Artificial Sequence; identical to SEQ ID NO: 13247
  Synthetic polypeptide

SEQ ID NO: 15707 - DNA, 1864 bp, Artificial Sequence
  Synthetic polypeptide
gtccagaatgacagggtccagaaactggcgagccacgagggacatgtgtaggtatcggcacaactatccggatctggtggaacgagactgcaatggggacacgccaaacctgagtttctacagaaatgagatccgcttcctgcccaacggctgtttcattgaggacattcttcagaactggacggacaactatgacctccttgaggacaatcactcctacatccagtggctgtttcctctgcgagaaccaggagtgaactggcatgccaagcccctcacgctcagggaggtcgaggtgtttaaaagctcccaggagatccaggagcggcttgtccgggcctacgagctcatgctgggcttctacgggatccggctggaggaccgaggcacgggcacggtgggccgagcacagaactaccagaagcgcttccagaacctgaactggcgcagccacaacaacctccgcatcacacgcatcctcaagtcgctgggtgagctgggcctcgagcacttccaggcgccgctggtccgcttcttcctggaggagacgctggtgcggcgggagctgccgggggtgcggcagagtgccctggactacttcatgttcgccgtgcgctgccgacaccagcgccgccagctggtgcacttcgcctgggagcacttccggccccgctgcaagttcgtctgggggccccaagacaagctgcggaggttcaagcccagctctctgccccatccgctcgagggctccaggaaggtggaggaggaaggaagccccggggaccccgaccacgaggccagcacccagggtcggacctgtgggccagagcatagcaagggtgggggcagggtggacgaggggccccagccacggagcgtggagccccaggatgcgggacccctggagaggagccagggggatgaggcagggggccacggggaagataggccggagcccttaagccccaaagagagcaagaagaggaagctggagctgagccggcgggagcagccgcccacagagccaggccctcagagtgcctcagaggtggagaagatcgctctgaatttggaggggtgtgccctcagccagggcagcctcaggacggggacccaggaagtgggcggtcaggaccctggggaggcagtgcagccctgccgccaacccctgggagccagggtggccgacaaggtgaggaagcggaggaaggtggatgagggtgctggggacagtgctgcggtggccagtggtggtgcccagaccttggcccttgccgggtcccctgccccatcggggcaccccaaggctggacacagtgagaacggggttgaggaggacacagaaggtcgaacggggcccaaagaaggtacccctgggagcccatcggagaccccaggccccagcccagcaggacctgcaggggacgagccagccgagagcccatcggagaccccaggcccccgcccagcaggacctgcaggggacgagccagccgagagcccatcggagaccccaggcccccgcccggcaggacctgcaggggacgagccagccgagagcccatcggagaccccaggccccagcccggcaggacctacaagggatgagccagccgagagcccatcggagaccccaggcccccgcccggcaggacctgcaggggacgagccagccgagagcccatcggagaccccaggcccccgcccggcaggacctgcaggggacgagccagccgagagcccatcggagaccccaggccccagcccggcaggacctacaagggatgagccagccaaggcgggggaggcagcagagttgcaggacgcagaggtggagtcttctgccaagtctgggaagccttaa

SEQ ID NO: 15708 - DNA, 1067 bp, Artificial Sequence; identical to SEQ ID NO: 9936
  Synthetic polypeptide

SEQ ID NO: 15709 - DNA, 968 bp, Artificial Sequence; identical to SEQ ID NO: 9937
  Synthetic polypeptide

SEQ ID NO: 15710 - DNA, 7615 bp, Artificial Sequence
  Synthetic polypeptide
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggagtctcaataggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 15711 - DNA, 7606 bp, Artificial Sequence
  Synthetic polypeptide
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggctcatgatcgttcagaaagtggagaattggcatttattaaacaactagttcgaaagatcctaattgttattgcccgccctgctcggttattagagtgcctggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggccgggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctgaagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaa

SEQ ID NO: 15712 - DNA, 487 bp, Artificial Sequence
  Synthetic polypeptide
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgatagattcccagaagtggaattgcttggtcaaacgccctgtgtgtccaaatgctgggagaacatcaccccttggatga

SEQ ID NO: 15713 - DNA, 451 bp, Artificial Sequence
  Synthetic polypeptide
gagggaggagccaagatggccgaataggaacagctcaggtctacagctcccagcgtgagcgacgcaggaaacggtgatttctgcatttccatctgagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttccctgtgtgtccaaatgctgggagaacatcaccccttggatga

SEQ ID NO: 15714 - DNA, 852 bp, Artificial Sequence; identical to SEQ ID NO: 753
  Synthetic polypeptide

SEQ ID NO: 15715 - DNA, 311 bp, Artificial Sequence; identical to SEQ ID NO: 13308
  Synthetic polypeptide

SEQ ID NO: 15716 - DNA, 1317 bp, Artificial Sequence; identical to SEQ ID NO: 7058
  Synthetic polypeptide

SEQ ID NO: 15717 - DNA, 2624 bp, Artificial Sequence
  Synthetic polypeptide
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggtcatatcaggggagcggttacctaagccggagcgggggaagatgagagtgcacaaaatcaacaatgtgaacaaagcgctggactttattgccagcaaaggcgtcaagctggtctccatcggggcagaagagattgtggacggcaacgcaaagatgaccctgggaatgatctggaccatcatccttaggttcgccatccaggacatctccgtggaagagacctcggccaaggaagggctccttctctggtgccagagaaagacagccccgtataagaacgtcaatgtgcagaacttccacatcagctggaaggatggtcttgccttcaatgccctgatccaccggcacagaccagagctgattgagtatgacaagctgaggaaggacgaccctgtcaccaacctgaacaatgccttcgaagtggctgagaaatacctcgacatccccaagatgctggatgcagaggacatcgtgaacacggcccggcccgacgagaaggccataatgacctatgtgtccagcttctaccatgccttttcaggagcgcagaaggctgaaactgccgccaaccggatctgtaaggtgctggctgtcaaccaagagaacgagcacctgatggaggactacgagaagctggccagcgacctcctggagtggatccggcgcaccatcccctggctggaggaccgtgtgccccaaaagactatccaggagatgcagcagaagctggaggacttccgcgactaccggcgtgtgcacaagccgcccaaggtgcaggagaagtgccagctggagatcaacttcaacacgctgcagaccaagctgcgcctcagcaaccggcccgccttcatgccctccgagggcaagatggtctcggacatcaacaatggctggcagcacttggagcaggctgagaagggctacgaggagtggctgctgaatgagatccgcaggctggagcggctcgaccacctggcagagaagttccggcagaaggcctccatccacgaggcctggactgacgggaaggaagccatgctgaagcaccgggactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15718 - DNA, 1454 bp, Artificial Sequence
  Synthetic polypeptide
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggttcacgagctggattactacgactcccacaatgtcaacacccggtgccagaagatctgtgaccagtgggacgccctcggctctctgacacatagtcgcagggaagccctggagaaaacagagaagcagctggaggccatcgaccagctgcacctggaatacgccaagcgcgcggcccccttcaacaactggatggagagcgccatggaggacctccaggacatgttcatcgtccataccatcgaggagattgagggcctgatctcagcccatgaccagttcaagtccaccctgccggacgccgatagggagcgcgaggccatcctggccatccacaaggaggcccagaggatcgctgagagcaaccacatcaagctgtcgggcagcaacccctacaccaccgtcaccccgcaaatcatcaactccaagtgggagaaggtgcagcagctggtgccaaaacgggaccatgccctcctggaggagcagagcaagcagcagtccaacgagcacctgcgccgccagttcgccagccaggccaatgttgtggggccctggatccagaccaagatggaggagatcgggcgcatctccattgagatgaacgggaccctggaggaccagctgagccacctgaagcagtatgaacgcagcatcgtggactacaagcccaacctggacctgctggagcagcagcaccagctcatccaggaggccctcatcttcgacaacaagcacaccaactataccatggagcacatccgcgtgggctgggagcagctgctcaccaccattgcccgcaccatcaacgaggtggagaaccagatcctcacccgcgacgccaagggcatcagccaggagcagatgcaggagttccgggcgtccttcaaccacttcgacaaggatcatggcggggcgctggggcccgaggagttcaaggcctgcctcatcagcctgggctacgacgtggagaacgaccggcagggtgaggccgagttcaaccgcatcatgagcctggtcgaccccaaccatagcggccttgtgaccttccaagccttcatcgacttcatgtcgcgggagaccaccgacacggacacggctgaccaggtcatcgcttccttcaaggtcttagcaggggacaagaacttcatcacagctgaggagctgcggagagagctgccccccgaccaggccgagtactgcatcgcccgcatggcgccataccagggccctgacgccgtgcccggtgccctcgactacaagtccttctccacggccttgtatggcgagagcgacctgtga

SEQ ID NO: 15719 - DNA, 197 bp, Artificial Sequence
  Synthetic polypeptide
gccgggtgtggtggctcacgcctgtaatcccagcactttgggaggtcgagaccttcacggcatggtgcaactcccacctgcggaaggcaggcacacagatcgagaacattgatgaggacttccgagacgggctcaagctcatgctgctcctggaggtcatatcagaggagctgagttggcagaccgggcccccctga

SEQ ID NO: 15720 - DNA, 1083 bp, Artificial Sequence; identical to SEQ ID NO: 7080
  Synthetic polypeptide

SEQ ID NO: 15721 - DNA, 888 bp, Artificial Sequence; identical to SEQ ID NO: 9660
  Synthetic polypeptide

SEQ ID NO: 15722 - DNA, 1254 bp, Artificial Sequence; identical to SEQ ID NO: 9661
  Synthetic polypeptide

SEQ ID NO: 15723 - DNA, 1104 bp, Artificial Sequence; identical to SEQ ID NO: 9662
  Synthetic polypeptide

SEQ ID NO: 15724 - DNA, 215 bp, Artificial Sequence; identical to SEQ ID NO: 13496
  Synthetic polypeptide

SEQ ID NO: 15725 - DNA, 441 bp, Artificial Sequence; identical to SEQ ID NO: 13497
  Synthetic polypeptide

SEQ ID NO: 15726 - DNA, 444 bp, Artificial Sequence; identical to SEQ ID NO: 13498
  Synthetic polypeptide

SEQ ID NO: 15727 - DNA, 432 bp, Artificial Sequence; identical to SEQ ID NO: 13499
  Synthetic polypeptide

SEQ ID NO: 15728 - DNA, 809 bp, Artificial Sequence; identical to SEQ ID NO: 8613
  Synthetic polypeptide

SEQ ID NO: 15729 - DNA, 2595 bp, Artificial Sequence
  Synthetic polypeptide
gcggttaagactgtgactccagaatcaagatcctgagcttgaaggtggtctctgccacgcaccagctgtgggccttgggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaatgttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactag

SEQ ID NO: 15730 - DNA, 1284 bp, Artificial Sequence; identical to SEQ ID NO: 648
  Synthetic polypeptide

SEQ ID NO: 15731 - DNA, 1077 bp, Artificial Sequence; identical to SEQ ID NO: 649
  Synthetic polypeptide

SEQ ID NO: 15732 - DNA, 972 bp, Artificial Sequence; identical to SEQ ID NO: 650
  Synthetic polypeptide

SEQ ID NO: 15733 - DNA, 1617 bp, Artificial Sequence
  Synthetic polypeptide
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactgacactctgcactcgctcatctccgagctgagcccgcaggagaaggaggactcggtcatcgtggtgctgatcgccgagactgactcacagtacacttcggcagtgacagagaacatcaaggccttgttccccacggagatccattctgggctcctggaggtcatctcaccctccccccacttctaccctgacttctcccgcctccgagagtcctttggggaccccaaggagagagtcaggtggaggaccaaacagaacctcgattactgcttcctcatgatgtacgcgcagtccaaaggcatctactacgtgcagctggaggatgacatcgtggccaagcccaactacctgagcaccatgaagaactttgcactgcagcagccttcagaggactggatgatcctggagttctcccagctgggcttcattggtaagatgttcaagtcgctggacctgagcctgattgtagagttcattctcatgttctaccgggacaagcccatcgactggctcctggaccatattctgtgggtgaaagtctgcaaccccgagaaggatgcgaagcactgtgaccggcagaaagccaacctgcggatccgcttcaaaccgtccctcttccagcacgtgggcactcactcctcgctggctggcaagatccagaaactgaaggacaaagactttggaaagcaggcgctgcggaaggagcatgtgaacccgccagcagaggtgagcacgagcctgaagacataccagcacttcaccctggagaaagcctacctgcgcgaggacttcttctgggccttcacccctgccgcgggggacttcatccgcttccgcttcttccaacctctaagactggagcggttcttcttccgcagtgggaacatcgagcacccggaggacaagctcttcaacacgtctgtggaggtgctgcccttcgacaaccctcagtcagacaaggaggccctgcaggagggccgcaccgccaccctccggtaccctcggagccccgacggctacctccagatcggctccttctacaagggagtggcagagggagaggtggacccagccttcggccctctggaagcactgcgcctctcgatccagacggactcccctgtgtgggtgattctgagcgagatcttcctgaaaaaggccgactaa

SEQ ID NO: 15734 - DNA, 399 bp, Artificial Sequence
  Synthetic polypeptide
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacagaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagactga

SEQ ID NO: 15735 - DNA, 450 bp, Artificial Sequence
  Synthetic polypeptide
ggccgtgcgtggtggctcacgcctgtaatcccagcactttgtgaggccgaggcgggcggatcacaaggcgacgttgtggacgtttaccagcgggagttcctggcgctgcgcgatcggttgcacgcagctgagcaggagagcctcaagcgctccaaggagctcaacctggtgctggacgagatcaagagggccgtgtcagaaaggcaggcgctgcgagacggagacggcaatcgcacctggggccgcctaacaggacccccgattgaagccgtggaacggctcacaccggcacgtgctgcacctgcccaccgtcttccatcacctgccacacctgctggccaaggagagcagtctgcagcccgcggtgcgcgtgggccagggccgcaccggagtgtcggtggtgatgggcatcccgagcgtgcggcgcgaggtgcactcgtacctgactga

SEQ ID NO: 15736 - DNA, 1498 bp, Artificial Sequence
  Synthetic polypeptide
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatga

SEQ ID NO: 15737 - DNA, 659 bp, Artificial Sequence
  Synthetic polypeptide
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaag

SEQ ID NO: 15738 - DNA, 619 bp, Artificial Sequence
  Synthetic polypeptide
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagattaaaagaagctgtgcattttcactgttttcttttttcatctag

SEQ ID NO: 15739 - DNA, 543 bp, Artificial Sequence
  Synthetic polypeptide
caagttacgtaacttctctaagcctttgttttctcattggtaaaatatgtatggtaacattgtctccctcacgggatggatgtgatgagtatctgaggtaatgcattaaaaagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgta

SEQ ID NO: 15740 - DNA, 1912 bp, Artificial Sequence; identical to SEQ ID NO: 8999
  Synthetic polypeptide

SEQ ID NO: 15741 - DNA, 999 bp, Artificial Sequence; identical to SEQ ID NO: 7471
  Synthetic polypeptide

SEQ ID NO: 15742 - DNA, 3220 bp, Artificial Sequence; identical to SEQ ID NO: 8585
  Synthetic polypeptide

SEQ ID NO: 15743 - DNA, 835 bp, Artificial Sequence
  Synthetic polypeptide
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctga

SEQ ID NO: 15744 - DNA, 787 bp, Artificial Sequence
  Synthetic polypeptide
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctga

SEQ ID NO: 15745 - DNA, 594 bp, Artificial Sequence
  Synthetic polypeptide
tgatatgtttggctgtgtccccacccaaacttcaacttgaattgtatctcccagaattcccctatgttgtgggaaggacccagggggaagtaattgaatcatggggaccggtctttcccatgctattctcctaatagtaagtaagtgtcaagagatctgaggggtttatcaggggtttctgcttttgcttcttcctcattctctcttgctgccgccatgtaagaagtgccttttgccctcagccatgaaagtgaaacctctccagccatgtggaactgttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtga

SEQ ID NO: 15746 - DNA, 1218 bp, Artificial Sequence; identical to SEQ ID NO: 654
  Synthetic polypeptide

SEQ ID NO: 15747 - DNA, 255 bp, Artificial Sequence
  Synthetic polypeptide
gactgggcgcagtggctcacgcctgtgatcccagcactttgggagggtgagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatag

SEQ ID NO: 15748 - DNA, 211 bp, Artificial Sequence
  Synthetic polypeptide
gactgggcgcagtggctcacgcctgtgatcccagcactttgggagggtgagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctata

SEQ ID NO: 15749 - DNA, 503 bp, Artificial Sequence; identical to SEQ ID NO: 493
  Synthetic polypeptide

SEQ ID NO: 15750 - DNA, 476 bp, Artificial Sequence; identical to SEQ ID NO: 495
  Synthetic polypeptide

SEQ ID NO: 15751 - DNA, 539 bp, Artificial Sequence; identical to SEQ ID NO: 496
  Synthetic polypeptide

SEQ ID NO: 15752 - DNA, 1790 bp, Artificial Sequence; identical to SEQ ID NO: 8350
  Synthetic polypeptide

SEQ ID NO: 15753 - DNA, 645 bp, Artificial Sequence
  Synthetic polypeptide
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctga

SEQ ID NO: 15754 - DNA, 468 bp, Artificial Sequence
  Synthetic polypeptide
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtg

SEQ ID NO: 15755 - DNA, 201 bp, Artificial Sequence
  Synthetic polypeptide
cccaaaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgagtctgcggctatcctc

SEQ ID NO: 15756 - DNA, 112 bp, Artificial Sequence
  Synthetic polypeptide
cccaaaggtattgacctgatggacatggcttcggacatcctgcagcccaaaggagatgatgtggcccggatcagctggtacctccgtgacatcatcactcgataccaggaga

SEQ ID NO: 15757 - DNA, 1234 bp, Artificial Sequence; identical to SEQ ID NO: 13601
  Synthetic polypeptide

SEQ ID NO: 15758 - DNA, 981 bp, Artificial Sequence; identical to SEQ ID NO: 12548
  Synthetic polypeptide

SEQ ID NO: 15759 - DNA, 4908 bp, Artificial Sequence; identical to SEQ ID NO: 11516
  Synthetic polypeptide

SEQ ID NO: 15760 - DNA, 4611 bp, Artificial Sequence; identical to SEQ ID NO: 11517
  Synthetic polypeptide

SEQ ID NO: 15761 - DNA, 5142 bp, Artificial Sequence; identical to SEQ ID NO: 11518
  Synthetic polypeptide

SEQ ID NO: 15762 - DNA, 777 bp, Artificial Sequence; identical to SEQ ID NO: 11519
  Synthetic polypeptide

SEQ ID NO: 15763 - DNA, 191 bp, Artificial Sequence; identical to SEQ ID NO: 6971
  Synthetic polypeptide

SEQ ID NO: 15764 - DNA, 194 bp, Artificial Sequence; identical to SEQ ID NO: 6972
  Synthetic polypeptide

SEQ ID NO: 15765 - DNA, 424 bp, Artificial Sequence
  Synthetic polypeptide
gaccaggcgcggcggctcacgcctgtgatcccagcactgggaggccgaggcaggcggatcactggaggtctgcagttcaagaccagcctggccaacgtggcaaagccccatctctactgaaaatacaagaaaattagccaggcgtgatgtgcataaatcacctgttttggatacaaagcccaaggagacaggtggaatcctgggggaaggcacaccgaaagaaagcagtactgaaagcagccagtcggccaagcctgtctctggccaagacacatcagggaatacagaaggttcacccgcagcggaaaaggcccagctcaagtctgaagccgcaggcagcccagaccaaggcagcacatacagccccgcaagaggtgtggctggaccacgtggacaggatccggtcagcagcccctgtggctag

SEQ ID NO: 15766 - DNA, 276 bp, Artificial Sequence
  Synthetic polypeptide
cagtcagccttctgtatctgtgggttctgcatccaagggttcaacccacggcagagtcacccaactgtgaactgaaaatattcaggaaaaaaatggatgattgcatctgtactgaacagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtga

SEQ ID NO: 15767 - DNA, 346 bp, Artificial Sequence; identical to SEQ ID NO: 13741
  Synthetic polypeptide

SEQ ID NO: 15768 - DNA, 323 bp, Artificial Sequence; identical to SEQ ID NO: 13742
  Synthetic polypeptide

SEQ ID NO: 15769 - DNA, 279 bp, Artificial Sequence
  Synthetic polypeptide
gccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggctggagtgcagtggcgcgatctcggctcactgcaacctccgcctcccaggttcaaccaattctcctgcctcagcctcccgagtag

SEQ ID NO: 15770 - DNA, 751 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaa

SEQ ID NO: 15771 - DNA, 338 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagatttta

SEQ ID NO: 15772 - DNA, 110 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgtt

SEQ ID NO: 15773 - DNA, 73 bp, Artificial Sequence
  Synthetic polypeptide
ggctggttttaagacaattatctcctatattgatgagcaatttgagaggtacctgcatgacgagagcggcttg

SEQ ID NO: 15774 - DNA, 148 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgttgcttttactttatttcaccttttggacatggacttaag

SEQ ID NO: 15775 - DNA, 58 bp, Artificial Sequence
  Synthetic polypeptide
ggctggttttaagacaattatctcctatattgatgagcaatttgagaggtacctgcat

SEQ ID NO: 15776 - DNA, 185 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 15777 - DNA, 234 bp, Artificial Sequence
  Synthetic polypeptide
ggctggttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaa

SEQ ID NO: 15778 - DNA, 237 bp, Artificial Sequence; identical to SEQ ID NO: 10809
  Synthetic polypeptide

SEQ ID NO: 15779 - DNA, 4080 bp, Artificial Sequence; identical to SEQ ID NO: 10810
  Synthetic polypeptide

SEQ ID NO: 15780 - DNA, 4119 bp, Artificial Sequence; identical to SEQ ID NO: 10811
  Synthetic polypeptide

SEQ ID NO: 15781 - DNA, 595 bp, Artificial Sequence; identical to SEQ ID NO: 10812
  Synthetic polypeptide

SEQ ID NO: 15782 - DNA, 921 bp, Artificial Sequence; identical to SEQ ID NO: 8811
  Synthetic polypeptide

SEQ ID NO: 15783 - DNA, 241 bp, Artificial Sequence
  Synthetic polypeptide
ggcgggggcggggccgagcacgcgcgtgcgcagaaaggccggcgcggcaggctgaggagaaagcggcgcgcggagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatga

SEQ ID NO: 15784 - DNA, 464 bp, Artificial Sequence
  Synthetic polypeptide
ggcgggggcggggccgagcacgcgcgtgcgcagaaaggccggcgcggcaggctgaggagaaagcggcgcgcggagccctgggcgctgcctatggcacagccaagagcggtaccggcattgcggccatgtctgtcatgcggccggagcagatcatgaagtccatcatcccagtggtcatggctggcatcatcgccatctacggcctggtggtggcagtcctcatcgccaactccctgaatgacgacatcagcctctacaagagcttcctccagctgggcgccggcctgagcgtgggcctgagcggcctggcagccggctttgccatcggcatcgtgggggacgctggcgtgcggggcaccgcccagcagccccgactattcgtgggcatgatcctgattctcatcttcgccgaggtgctcggcctctacggtctcatcgtcgccctcatcctctccacaaagtag

SEQ ID NO: 15785 - DNA, 990 bp, Artificial Sequence
  Synthetic polypeptide
ggcgagcggcgacggcggcggcggcgggcacagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15786 - DNA, 852 bp, Artificial Sequence
  Synthetic polypeptide
ggcgagcggcgacggcggcggcggcgggcacagacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15787 - DNA, 150 bp, Artificial Sequence
  Synthetic polypeptide
ggcgagcggcgacggcggcggcggcgggcacagacagatgcaccatcaggaatggaattacagtcatggtatcctgttataaagcaggaaggtgaccatgtttctcagacacattcatttttacaccccagatgcatcaatctcaaataa

SEQ ID NO: 15788 - DNA, 3701 bp, Artificial Sequence; identical to SEQ ID NO: 6659
  Synthetic polypeptide

SEQ ID NO: 15789 - DNA, 3527 bp, Artificial Sequence; identical to SEQ ID NO: 6660
  Synthetic polypeptide

SEQ ID NO: 15790 - DNA, 457 bp, Artificial Sequence; identical to SEQ ID NO: 6661
  Synthetic polypeptide

SEQ ID NO: 15791 - DNA, 359 bp, Artificial Sequence; identical to SEQ ID NO: 6662
  Synthetic polypeptide

SEQ ID NO: 15792 - DNA, 588 bp, Artificial Sequence; identical to SEQ ID NO: 6663
  Synthetic polypeptide

SEQ ID NO: 15793 - DNA, 1986 bp, Artificial Sequence
  Synthetic polypeptide
agccaggcatggtgatgcgtgcctgtagccccagctacgtgggaggccgagtaccccccaggcatgcggcagcaggtgttccagttcttcagcaaggttctggcgcaggtgcagcaccccctgctgcattacctcagcgtccacaggcctgtgcagaaactcctccgacttggtgggactgcttccggatccgttacagaaaaggaggaggtgcagttcaccaccgtcctctgctccaagatccagcaggacccagagctgctcgcctacatcctggaaggtaaaaagattgtaggtaggaagaaagcatgcggagaacccactgccctgcctaaggacacaaccagccacggggacaaggactgctcccacgatggtgctcctgccaggccccagctggacggggagtcctgtggggcccaggccttgaacagccacatgcctgctgagaccgaggagctggacggtgggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagttgtaccggtccatgcctgtcttcctggaccccgcagacattgccaccttagagggcatcagctggaggttacccagtgccccgtctgatgaggcttccttccctggcaaggaggccttggctgccttcttgggctggtttgattactgcgaccacctcatcacagaggcacacacggtggttgcggacgccttggcgaaggctgtggctgagaacttcttcgtggagaccctgcagccccagctcctgcacgtgtccgagcagagcatcttgacctccaccgccctcctcacagccatgctgcgccagcttcgctcccctgcgctgctgcgggaggccgtggctttcctcctgggcacagaccggcagcctgaagcccccggggacaacccccacaccctgtatgctcatctcatcgggcattgtgaccacctctctgatgagatcagcatcaccacactccggctgtttgaggagctgctgcagaagccccacgaggggatcatccacagcctggtcctgcgcaaccttgagggccgcccttacgtggcctggggctcaccagagcctgagagctatgaggacaccctagacctggaggaagacccctacttcaccgacagcttcctggattccggctttcaaactcccgcaaagcctcgcctagctcctgctaccagttacgatggcaaaacagcagtgaccgagatcgtcaacagtttcctgtgcctggtccccgaggaagccaagacctctgccttcctggaggagacaggctatgacacatacgtccacgatgcttatggcctgttccaggagtgcagctcccgcgtcgcctcctggggctggcctctgacccccacacctttggacccccatgagcccgagcgacctttcttcgagggccacttcctccgagtgctgtttgaccgcatgtcccggattctggatcagccatacagcctgaacctgcaggtgacctcggtcctgtcccggcttgccctcttcccccacccccatattcatgagtacctgctggatccgtacatcagcctggcccccggctgcaggagcctattctccgtgttggtgagggtgatcggggacttgatgcagagaatccagagggtaccccagttcccaggcaagctgctcctggtgcgcaagcagttgacgggccaggctcctggggagcagctggaccaccagaccctcctccagggcgtggtggtgctggaggagttctgcaaggagctggctgccattgccttcgtcaagtttcccccacatgatcctcgccagaacgtctccccagccccggaagggcaggtctga

SEQ ID NO: 15794 - DNA, 367 bp, Artificial Sequence; identical to SEQ ID NO: 13636
  Synthetic polypeptide

SEQ ID NO: 15795 - DNA, 358 bp, Artificial Sequence; identical to SEQ ID NO: 13637
  Synthetic polypeptide

SEQ ID NO: 15796 - DNA, 1966 bp, Artificial Sequence
  Synthetic polypeptide
ggcggcgctgccgctcccgggcggccgcgggcggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtgggcacacgttctgtaggagatgcgccttgaagtcagagaagtgtcccgtggacaacgtcaaactgaccgtggtggtgaacaacatcgcggtggccgagcagatcggggagctcttcatccactgccggcacggctgccgggtagcgggcagcgggaagccccccatctttgaggtggacccccgagggtgccccttcaccatcaagctcagcgcccggaaggaccacgagggcagctgtgactacaggcctgtgcggtgtcccaacaaccccagctgccccccgctgctcaggatgaacctggaggcccacctcaaggagtgcgagcacatcaaatgcccccactccaagtacgggtgcacgttcatcgggaaccaggacacttacgagacccacctggagacttgccgcttcgagggcctgaaggagtttctgcagcagacggatgaccgcttccacgagatgcacgtggctctggcccagaaggaccaggagatcgccttcctgcgctccatgctgggaaagctctcggagaagatcgaccagctagagaagagcctggagctcaagtttgacgtcctggacgaaaaccagagcaagctcagcgaggacctcatggagttccggcgggacgcatccatgttaaatgacgagctgtcccacatcaacgcgcggctgaacatgggcatcctaggctcctacgaccctcagcagatcttcaagtgcaaagggacctttgtgggccaccagggccctgtgtggtgtctctgcgtctactccatgggtgacctgctcttcagtggctcctctgacaagaccatcaaggtgtgggacacatgtaccacctacaagtgtcagaagacactggagggccatgatggcatcgtgctggctctctgcatccaggggtgcaaactctacagcggctctgcagactgcaccatcattgtgtgggacatccagaacctgcagaaggtgaacaccatccgggcccatgacaacccggtgtgcacgctggtctcctcacacaacgtgctcttcagcggctccctgaaggccatcaaggtctgggacatcgtgggcactgagctgaagttgaagaaggagctcacaggcctcaaccactgggtgcgggccctggtggctgcccagagctacctgtacagcggctcctaccagacaatcaagatctgggacatccgaacccttgactgcatccacgtcctgcagacgtctggtggcagcgtctactccattgctgtgacaaatcaccacattgtctgtggcacctacgagaacctcatccacgtgtgggacattgagtccaaggagcaggtgcggaccctcacgggccacgtgggcaccgtgtatgccctggcggtcatctcgacgccagaccagaccaaagtcttcagtgcatcctacgaccggtccctcagggtctggagtatggacaacatgatctgcacgcagaccctgctgcgtcaccagggcagtgtcaccgcgctggctgtgtcccggggccgactcttctcaggggctgtggatagcactgtgaaggtttggacttgctaa

SEQ ID NO: 15797 - DNA, 96 bp, Artificial Sequence
  Synthetic polypeptide
ggcggcgctgccgctcccgggcggccgcgggcggaccagaatggaaacgaccttcggacccgccttttcagccgtcaccaccatcacaaaagctga

SEQ ID NO: 15798 - DNA, 394 bp, Artificial Sequence
  Synthetic polypeptide
ggcggcgctgccgctcccgggcggccgcgggcggaccagaatggaaacgaccttcggacccgccttttcagccgtcaccaccatcacaaaagctgacgggaccagcacctacaagcagcactgcaggacaccctcctcctccagcacccttgcctactccccgcgggacgaggaggacagcatgccccccatcagcactccccgccgctccgactccgccatctctgtccgctccctgcactcagagtccagcatgtctctgcgctccacattctcactgcccgaggaggaggaggagccggagccactggtgtttgcggagcagccctcggtgaagctgtgctgtcagctctgctgcagcgtcttcaaagaccccgtgatcaccacgtgtggg

SEQ ID NO: 15799 - DNA, 1518 bp, Artificial Sequence
  Synthetic polypeptide
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15800 - DNA, 1437 bp, Artificial Sequence
  Synthetic polypeptide
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15801 - DNA, 1395 bp, Artificial Sequence
  Synthetic polypeptide
ggctgcgcggtcagaggcgcctggagcgagcgaatcctggcccaccgcctgcccaaccgcgtgaccttgattgagttaatgaacttcacgcctcagcgtccaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtga

SEQ ID NO: 15802 - DNA, 354 bp, Artificial Sequence
  Synthetic polypeptide
gccagacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtggctttggctgaagcctaa

SEQ ID NO: 15803 - DNA, 2281 bp, Artificial Sequence
  Synthetic polypeptide
tggctgtcaagatggctgaataggaatagctccagtctgtagctcccagtgagatcaatgcaggaagtgggtgatttctgcatttccaactgagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactag

SEQ ID NO: 15804 - DNA, 809 bp, Artificial Sequence; identical to SEQ ID NO: 8643
  Synthetic polypeptide

SEQ ID NO: 15805 - DNA, 1114 bp, Artificial Sequence; identical to SEQ ID NO: 7732
  Synthetic polypeptide

SEQ ID NO: 15806 - DNA, 363 bp, Artificial Sequence; identical to SEQ ID NO: 7733
  Synthetic polypeptide

SEQ ID NO: 15807 - DNA, 113 bp, Artificial Sequence; identical to SEQ ID NO: 9062
  Synthetic polypeptide

SEQ ID NO: 15808 - DNA, 1099 bp, Artificial Sequence
  Synthetic polypeptide
tgggcaaaggacttgtggagttcaaagacgtacaagtgatcaacaaacacatggaaagttctcaacatcattagtcattaaagaaatgcacataaaaaaccacaatgaggtatcatttcctacccactaggatggctatttaaaaacacaaaaggaaagtaacaagtatgattgaggacgtggagaaattggagcccttatacgttgctcatgtgaatgtaaaatggtacagccaccatggcaattccttaaaaagttaaactaaggtttcccatgtgactcagcagttccacctgttgtgtatgcccaaaagaattgaaaacagatactcaaatacatgtatatgcatattcatagcagctctattcataaaagccaaaaggtggaatttaacagctctattcataaaagccaaaaggtggaaacaatttagatttccatcaggagatgattggatagacaaattatggtgtacgcatacagtggagtattattcagtcataaaaacggtatactaatatgtgctgcataatacggacggaccttaaacatactaagtgaaagaagccagacacaaaagctaacatgttgtttgcttctatttcatgaagtatccaaaataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctga

SEQ ID NO: 15809 - DNA, 421 bp, Artificial Sequence
  Synthetic polypeptide
gccgggcgcagttgctcacgcctgtaatcccagcactttgggaggccgaggtgggcggatcatctgagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggtgcagggggctggctgtgggcaatggactctcctcctatga

SEQ ID NO: 15810 - DNA, 1222 bp, Artificial Sequence
  Synthetic polypeptide
gccgggcgcagttgctcacgcctgtaatcccagcactttgggaggccgaggtgggcggatcatctgagagcatggccccttcctggtccagccagatggtgtcaccctggagtacaacccctattcttggaatctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactga

SEQ ID NO: 15811 - DNA, 1171 bp, Artificial Sequence
  Synthetic polypeptide
gccgggcgcagttgctcacgcctgtaatcccagcactttgggaggccgaggtgggcggatcatctgagagcatggccccttcctgattgccaatgtgttatacctggagtccccagctggggtgggcttctcctactccgatgacaagttttatgcaactaatgacactgaggtcgcccagagcaattttgaggcccttcaagatttcttccgcctctttccggagtacaagaacaacaaacttttcctgaccggggagagctatgctggcatctacatccccaccctggccgtgctggtcatgcaggatcccagcatgaaccttcaggggctggctgtgggcaatggactctcctcctatgagcagaatgacaactccctggtctactttgcctactaccatggccttctggggaacaggctttggtcttctctccagacccactgctgctctcaaaacaagtgtaacttctatgacaacaaagacctggaatgcgtgaccaatcttcaggaagtggcccgcatcgtgggcaactctggcctcaacatctacaatctctatgccccgtgtgctggaggggtgcccagccattttaggtatgagaaggacactgttgtggtccaggatttgggcaacatcttcactcgcctgccactcaagcggatgtggcatcaggcactgctgcgctcaggggataaagtgcgcatggaccccccctgcaccaacacaacagctgcttccacctacctcaacaacccgtacgtgcggaaggccctcaacatcccggagcagctgccacaatgggacatgtgcaactttctggtaaacttacagtaccgccgtctctaccgaagcatgaactcccagtatctgaagctgcttagctcacagaaataccagatcctattatataatggagatgtagacatggcctgcaatttcatgggggatgagtggtttgtggattccctcaaccagaagatggaggtgcagcgccggccctggttagtgaagtacggggacagcggggagcagattgccggcttcgtgaaggagttctcccacatcgcctttctcacgatcaagggcgccggccacatggttcccaccgacaagcccctcgctgccttcaccatgttctcccgcttcctgaacaagcagccatactga

SEQ ID NO: 15812 - DNA, 108 bp, Artificial Sequence
  Synthetic polypeptide
gccgggcgcagttgctcacgcctgtaatcccagcactttgggaggccgaggtgggcggatcatctgagagcatggccccttcctggtccagccagatggtgtcaccct

SEQ ID NO: 15813 - DNA, 993 bp, Artificial Sequence
  Synthetic polypeptide
tttctgaacgtcagttgttttctcatctgtaaaatgacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaagtaagtccatatcaagacagtcagagaaggctcacagtagtggtaaacttcaaaaaacagtgtcttatccagatgtctcacttgaggaacaggagaaaatggatttaaaaacaagtagagaattatgtagccgtttagatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15814 - DNA, 855 bp, Artificial Sequence
  Synthetic polypeptide
tttctgaacgtcagttgttttctcatctgtaaaatgacagatgcaccatcaggaatggaattacagtcatggtatcctgttataaagcaggaaggtgaccatgtttctcagacacattcatttttacaccccagctactacttatacatgtgtgataaagtggttgccccaaatgtgtcacttacttctgctgtatcccagtctaaagagctcacaaagacagaggcaaatgcatcaatctcaaataattctacaagtaaaaggaaatctgagtctgccacttgcaacttagtcagagacataaacaaagtgggaattggccttgttgctgccgcttcatctccgcttcttgtgaaagatgtcatttgtgaggatgataagggaaaaatcatggaagaagtaatgagaacttatttaaaacaacaggaaaaactaaacttgattttgcaaaagaagcaacaacttcagatggaagtaaaaatgttgagtagttcaaaatctatgaaggaactcactgaagaacagcagaatttacagaaagagcttgaatctttgcagaatgaacatgctcaaagaatggaagaattttatgttgaacagaaagacttagagaaaaaattggagcagataatgaagcaaaaatgtacctgtgactcaaatttagaaaaagacaaagaggctgaatatgcaggacagttggcagaactgaggcagagattggaccatgctgaggccgataggcaagaactccaagatgaactcagacaggaacgggaagcaagacagaagttagagatgatgataaaagagctaaagctgcaaattctgaaatcatcaaagactgctaaagaatag

SEQ ID NO: 15815 - DNA, 153 bp, Artificial Sequence
  Synthetic polypeptide
tttctgaacgtcagttgttttctcatctgtaaaatgacagatgcaccatcaggaatggaattacagtcatggtatcctgttataaagcaggaaggtgaccatgtttctcagacacattcatttttacaccccagatgcatcaatctcaaataa

SEQ ID NO: 15816 - DNA, 829 bp, Artificial Sequence; identical to SEQ ID NO: 8675
  Synthetic polypeptide

SEQ ID NO: 15817 - DNA, 2624 bp, Artificial Sequence; identical to SEQ ID NO: 8408
  Synthetic polypeptide

SEQ ID NO: 15818 - DNA, 2678 bp, Artificial Sequence; identical to SEQ ID NO: 8409
  Synthetic polypeptide

SEQ ID NO: 15819 - DNA, 2717 bp, Artificial Sequence; identical to SEQ ID NO: 8410
  Synthetic polypeptide

SEQ ID NO: 15820 - DNA, 2624 bp, Artificial Sequence; identical to SEQ ID NO: 8411
  Synthetic polypeptide

SEQ ID NO: 15821 - DNA, 2783 bp, Artificial Sequence; identical to SEQ ID NO: 8412
  Synthetic polypeptide

SEQ ID NO: 15822 - DNA, 2696 bp, Artificial Sequence; identical to SEQ ID NO: 8413
  Synthetic polypeptide

SEQ ID NO: 15823 - DNA, 2678 bp, Artificial Sequence; identical to SEQ ID NO: 8414
  Synthetic polypeptide

SEQ ID NO: 15824 - DNA, 677 bp, Artificial Sequence; identical to SEQ ID NO: 8415
  Synthetic polypeptide

SEQ ID NO: 15825 - DNA, 183 bp, Artificial Sequence; identical to SEQ ID NO: 13314
  Synthetic polypeptide

SEQ ID NO: 15826 - DNA, 104 bp, Artificial Sequence; identical to SEQ ID NO: 13315
  Synthetic polypeptide

SEQ ID NO: 15827 - DNA, 1085 bp, Artificial Sequence
  Synthetic polypeptide
gggcgcggggcgcgccgccatgggcctggccgggctgcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaa

SEQ ID NO: 15828 - DNA, 2556 bp, Artificial Sequence
  Synthetic polypeptide
ggtacacactgcagtgtgggtgaacgtcaaaagccgtgcagtgagagaagccaatcacagtaggcatccgtgggctctgagaagctctttgcgccgggaaccgataaaggcccagcgcttgagaagtcggaggccaaggccgggccggtgcccaaggtgtcaggcctggagcgcagccgcgagctcagcgccgagagcttcctgcccactgccagccccgcgccccatgccgcgccctgcccggggcccccgcccggctcccgcgccaatcccttggtgaagaaggaaccccccgccccgcaccgccacaccccgcagccgccacccccgcagccccgcggcctgctcccgacacacgtgcctgcatccctgggcgccttcgcgggccacagccaggcggcagccaacggcctgcacggcctcagcaggagcagcagcgcccccctgggcctggggaagcacgtgtcgctgtcgccacacgggccgggcccccacctgtctacctcacacctggcgctccggtcccaggcgcagcaccagctccacgcggccatgtttgccgcacccccgacactgcccccgcccccggcgctgccggccagcagcctggtcctcccaggacacccggccgatcacgagctgctcaggcaagagctgaacacgcggtttctggtgcagagcgccgagcggcctggcgcctccctgggcccgggggctctgctgcgggcggagttccatcagcaccagcacacacaccagcacacgcaccaacacacacaccagcaccaacacacattcgcccccttccccgcagggctgcccccgacgccgcccgccgcacccccgccgtttgacaagtatgcgcccaagctggacagcccctacttccgacattccagcgtgagtttcttcccgtccttccctcctgccatcccgggactgcccaccctgctcccacaccccggccccttcgggtccctgcagggcgcttttcagcctaaggtgtctgacccgtaccgggcggtggtcaaggtgagcacgtgttgggaaggcccgtggcaagggaggactctggtgcccccggggcggcctcggggggcccgtgacagcaggagtctgcagaaaacatgggtgggggtggcaccagccccactgagcgcttccatcctgtcgcagaagccggggaggtggtgtgccgtgcacgtgcagatcgcctggcagatctaccgtcaccagcagaagataaaggagatgcagctggacccccacaagctggaggtgggtgcaaagctggacctgttcggcagaccccctgccccgggcgtgtttgcaggcttccactacccacaggacctggcccggcccctcttccccagcacaggtgccgcccatcctgcctccaacccatttggaccctcagcccatcctggcagcttcctgcccactggccccctgacagaccctttcagcagaccgagcacctttgggggcctgggcagcctgagcagccacgcctttgggggcctgggcagccatgcactggctcccggtggcagcatctttgcccccaaggagggctcctccgtgcacggcctgcccagcccccatgaggcctggaaccgactgcaccgggcaccgccctccttcccggctccgcccccgtggcccaagtccgtggacgcggagcgggtgtcagccctgaccaaccatgaccgagagccggacaatggcaaggaggagcaggaacgggacctcctggagaagacgcgcctgctgagccgggcctcgcccgccacccccgctggccaccccgtcagcggcctcctgctccgggcccagagcgagctgggccggtccggggcccccgcggagcgcgaggccgaacctcgggtcaaggagagccgctccccggccaaggaggaggccgccaagatgcccgcgcgcgcatccccgccccacagcaaggcggcccctggagacgtgaaggtcaaggaggagcgcggggaggacgaggcctccgagcccccggcgggcggcctgcaccccgcgcccctgcagctcggcctgggccgcgagcgcctgggcgcgccgggcttcgcgtgggagcctttccgcggcctggagctgccacgtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtag

SEQ ID NO: 15829 - DNA, 2917 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15830 - DNA, 3148 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgaggtgtctgtctttaatacaggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15831 - DNA, 1278 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgg

SEQ ID NO: 15832 - DNA, 3130 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15833 - DNA, 2293 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggcaaggataaaagccatcaatacattttttgctaagaatggttatcgattaatggattctagtatctatagtcaccccattcaaactcaagcacagtatgcctccccagtctttatgcagcctgtatataatcctcaccaacagtactcggtctatagtattgtgcctcagtcttggtctccaaatcctacaccttactttgaaacaccactggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggtaa

SEQ ID NO: 15834 - DNA, 1462 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccct

SEQ ID NO: 15835 - DNA, 2917 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccggagaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgagaccaagtcataagcgttgtattgtaattcttagagagattcctgaaacaacaccaatagaggaagtgaaaggtttgttcaaaagtgaaaactgccccaaagtgataagctgtgagtttgcacacaatagcaactggtatatcactttccagtcagacacagatgcacaacaggcttttaaatacttaagagaagaagttaaaacatttcagggcaagccaattatggctccctttcccaatggtagttttgtgaatggctttaattcgccaggatcttataaaacaaatgctgctgctatgaatatgggtcgaccattccaaaaaaatcgtgtgaagcctcagtttaggtcatctggtggttcagaacactcaacagagggctctgtatccttgggggatggacagttgaacagatatagttcaagaaactttccagctgaacggcataaccccacagtaactgggcatcaggagcaaacttaccttcagaaggagacttccactttgcaggtggaacagaatggggactatggtaggggcaggagaactctcttcagaggtcgaagacgacgagaagatgacaggatctcaagacctcatccttcaacagctgaatcaaaggctccaacaccaaagtttgacttattagcctcaaattttccacctttacctggaagttcatcaagaatgccaggtgaactcgttttggagaataggatgtctgatgttgttaaaggtgtctacaaagaaaaggataatgaagagttgacaattagttgcccagtgcctgcagatgagcagacagaatgcacttctgcccagcaactcaatatgagtaccagttctccatgtgctgctgagcttactgcattaagcacaactcagcaagaaaaggatctaatagaagattcctctgttcagaaggatggtctcaatcagacaactataccagtttctcctccaagtactacaaagccatcgagggcaagtactgcttcaccatgtaataataacataaatgcagctacagctgtggctctacaggaaccccgaaagttaagttatgctgaagtgtgccagaagccccctaaagagccatcttcagttcttgtgcagccactacgggaacttcgctccaatgtggtgtctcccaccaaaaatgaagacaatggagctcctgagaactccgttgagaaaccacatgagaagccagaagcaagggctagtaaggattattctggcttccgaggcaatataatccccaggggagcagcaggaaaaatcagggaacagagacgccagtttagccatagggctatacctcagggagtgactcgacgtaatggcaaagagcaatatgtgccacccagatcaccaaagtaa

SEQ ID NO: 15836 - DNA, 1531 bp, Artificial Sequence
  Synthetic polypeptide
gcccatttaaacataatctttaataaaattcttacaaagttctaagaaaaatagccttacagtagaaaattatgaaggatgtaagtcattaggatcatgatttagcagaaaaaacaagtcacaaaataaagtcctcaaaattacaaatattggaattatcatcaagtgtagactataaaattaaaatgtttgatatgcttaaaagaagaaaaaagatgatccagaaacaaaaaagttgatcagatagatttgaggaaagaactaaaagaaactttaagaaatgaaaaatataaaaagggagcttagaaacttactagacaagttgaacagcaagttagaaacagcttgagaaaaatcagtgaactggaagaacgatcgtaagaaattgttcagaatgcaactagagagaccaaaatggaaaataggaaaacttgatacatggaacatatgatgacaaggtagcatatattttattggagtttcagaagagaataatagagcagttgtggagagtgaatattttaagagagaatggctgagaattttacagaattgatgaacgatttcagggagttcagcagatcccagttatatcagataaaaaacaatttcacacttagacttttaatgatcgtaaaacctcattaacaaatcagagagtaaagagagattaagaatggcagctaacctgatggctgattgcttgttagccatagtataaaccagaaagtacaggaatgtctttaaagtgcctgaaaggggttatatgcctattgataattctgtatatggcaaggatggttaaaaatgtattttcagagaaagcacaacttgagagaatttactaagaagttctgaatgatatcctttgggtaggcggtaaatgattccgaagaaaactccgagatgcaagaaagaacgatgaacaaagaaaatggtcaacattcatcatgtaaatttaagtaaatgttgacaggtagcatctaaaggaactggtttaaatcctaatgccaaagtatggcaagaaattgctcctggaaatactgatgccaccccagtaactcatggaactgaaagctcttggcatgaaatagcagctacatcaggtgctcatcctgagggtaatgcagagctctcagaagatatatgtaaagaatatgaagtaatgtattcttcatcttgtgaaaccacaagaaatactacaggcattgaagaatcaactgatgggatgattttaggaccagaagatctgagttaccaaatatatgatgtttccgaaagcaattcagcagtttctacagaagacctaaaagaatgtctgaagaaacaattagaattctgtttttcacgagaaaatttgtcaaaggatctttacttgatatctcaaatggatagtgatcagttcatcccaatttggacagttgccaacatggaagaaataaaaaagttgactacagaccctgatctaattcttgaagtgttaagatcttctcccatggtacaagttgatgagaagggtgagaaagtgaga

SEQ ID NO: 15837 - DNA, 1346 bp, Artificial Sequence; identical to SEQ ID NO: 7758
  Synthetic polypeptide

SEQ ID NO: 15838 - DNA, 331 bp, Artificial Sequence; identical to SEQ ID NO: 7504
  Synthetic polypeptide

SEQ ID NO: 15839 - DNA, 1454 bp, Artificial Sequence
  Synthetic polypeptide
tttcttggttccctgactgggaagcaaggtgattaatggacggtcaaggcagccccttaggcggcttaggcctgccctgtgggggactctggccagcttgagcgacgcagatcctgagagcgctcccgggtaggcaactgccccggtggaatgccttgccagagcagtgcgtggcaggcccccgtggaggatcaatgtggtggctgatcaccaggaaggaattggcacttggagtccggacatctgaaacttggaaaaatcagttgctgccgtctgacaaggtggatggtgagctgggtgccctgcggctcgaggatgtggaggatgagttgataagggaagaggtcatcctgtcgccagtcccatcagtgctcaagttgcagacagcatcaaaaccaattgacctctcagtagcaaaggaaataaagacccttctgtttggttccagcttttgctgtttcaatgaagaatggaaacttcagagtttttcctttagtaacacagcctcattaaaatacggcatagtgcagaacaagggtggtccttgcggagtcctggcagctgtccaaggctgtgtcctacagaaactcctgtttgaaggagatagcaaagccgactgtgctcagggactgcagccttcagatgcccaccggacccgctgcctcgtcctggccctcgcagacattgtgtggcgggcagggggccgagagagagccgttgttgcactggcttcgagaacacagcagttcagtccaacagggaaatacaaagcagatggagtcttagaaacacttacgcttcacagtttgacctgctatgaggacctggtgacttttcttcaacaaagcattcatcagtttgaagtgggcccctatggctgcatcctgctcaccctttctgccatcctgtccaggtctacagagctcatccgccaggactttgatgtccccaccagccacctgattggagcacatggctactgtacacaggaacttgtcaatctgctcctgactgggaaagctgtgtccaacgttttcaacgatgtggttgagctggattctggggatgggaacatcacacttctcagaggcattgctgcacgcagtgatattggcttcttatctctctttgagcattacaacatgtgccaggttggctgcttcctgaagaccccgaggttccccatctgggtggtttgcagtgagagccacttcagcatcctctttagcctgcagccggggctcctgcgtgactggaggactgagaggctctttgacttgtactactacgatggcctggccaaccagcaggagcagatccggctgaccattgacaccacccaaaccatctctgaggacacagacaacgaccttgtcccacccctcgagctctgcatcagaaccaagtggaagggggcatcagtgaactggaacggctcagaccccatcctgtga

SEQ ID NO: 15840 - DNA, 587 bp, Artificial Sequence; identical to SEQ ID NO: 10160
  Synthetic polypeptide

SEQ ID NO: 15841 - DNA, 1246 bp, Artificial Sequence; identical to SEQ ID NO: 10161
  Synthetic polypeptide

SEQ ID NO: 15842 - DNA, 1768 bp, Artificial Sequence; identical to SEQ ID NO: 10162
  Synthetic polypeptide

SEQ ID NO: 15843 - DNA, 1054 bp, Artificial Sequence; identical to SEQ ID NO: 10163
  Synthetic polypeptide

SEQ ID NO: 15844 - DNA, 553 bp, Artificial Sequence; identical to SEQ ID NO: 10164
  Synthetic polypeptide

SEQ ID NO: 15845 - DNA, 433 bp, Artificial Sequence; identical to SEQ ID NO: 14273
  Synthetic polypeptide

SEQ ID NO: 15846 - DNA, 168 bp, Artificial Sequence; identical to SEQ ID NO: 13695
  Synthetic polypeptide

SEQ ID NO: 15847 - DNA, 3717 bp, Artificial Sequence; identical to SEQ ID NO: 7131
  Synthetic polypeptide

SEQ ID NO: 15848 - DNA, 3636 bp, Artificial Sequence; identical to SEQ ID NO: 7132
  Synthetic polypeptide

SEQ ID NO: 15849 - DNA, 20 bp, Artificial Sequence
  Synthetic polypeptide
tgagaggattcctgagctga

SEQ ID NO: 15850 - DNA, 2822 bp, Artificial Sequence; identical to SEQ ID NO: 9433
  Synthetic polypeptide

SEQ ID NO: 15851 - DNA, 787 bp, Artificial Sequence
  Synthetic polypeptide
tgtcagtctaccccaggaggcagggatatccctaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccgtcaggaagaagaaagggaacagccccatctcctga

SEQ ID NO: 15852 - DNA, 814 bp, Artificial Sequence
  Synthetic polypeptide
tgtcagtctaccccaggaggcagggatatccctaaagactgtgaagccgtggcacgaaggtgacaaagcctgggtgtcgtgggagcagacttttaatatcactgtgacaaaggaattattaaagaaaataaatttccacaaaatcaccttgaggctctggaacactaaagacaagatgtcaagaaaagtcagatattaccgattaaagactgccggcttcacagacgacgtgggagcttttcataagtcagaagtgagacatttggttttaaatcagagaaaattatctgaacagggcattgagaataccaacattgtcagagaagagtcgaaccaggaacatccgccaggaaaacaagaaaaaacagaaaaacacccaaagtctttgcaaggttctcaccaagcagagcccgaaacttcttccaagaacagtgaggaatatgagaagtccctcaaaatggacgattcttccacgattcaatggagtgtttcaagaacaccaaccatttctttggcaggagcaagcatgatggagatcaaggaattaattgagagtgaatcacttagcagcttaacaaacatattagacagacaaaggtctcaaattaaagggaaagattcagagggaagaaggaaaatccagaggagacataagaagcccctggcagaagaagaggcagaccccacgctgacaggccccaggaagcagagcgctttctccatccagctggccgtcatgccgctccttgccggtacccactgcttgccctgttcccagcagctcctgcttgtcttgtggccagaacggccataa

SEQ ID NO: 15853 - DNA, 430 bp, Artificial Sequence
  Synthetic polypeptide
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaa

SEQ ID NO: 15854 - DNA, 478 bp, Artificial Sequence
  Synthetic polypeptide
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgtaagtacaaggaagtgggttaaaataaataatgtaaaaaagacattttag

SEQ ID NO: 15855 - DNA, 400 bp, Artificial Sequence
  Synthetic polypeptide
ctccaacctagcctttgtcagtagtaaagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttcttt

SEQ ID NO: 15856 - DNA, 1002 bp, Artificial Sequence
  Synthetic polypeptide
ggctgggcatggtggctcacgcctataatcctggcactttgggagactgaggcaagcgaattgcctgagctcaggagttcaagaccagctttggcaatacgacaaaaccccgtctctactacagatacaaaaaaaattaaccagctgggcttcgctgacttgaacctggccgagtttgcgggctcgggctccacggtgcgctgctgcctgctcgagggatatgacacgaagaacactcgccaggacaactccatccttaaggtcaccattggtatgttcctgctctctggagatccctgcttcaagacgccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcagggctgccagaggaacccgaccagaacctgtccagccctgaggaggtgttccactctggccactcccgcaactccagctatgccagccagcagtccaagatctccggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggcggaagaaggactcggtggagagccacccgacctgggtggacgacacgcggatcgatgcggatgccatcgtggagaagatcgtgcagagccaggatttcacagatggcagcaacaccgaggacagcaacctccggctgttcgtgagccgcgatggctctgccacgctgagcggcatccagcttgccaccagggtctcttctggggtctacgagccagttgtgattgaaagccattga

SEQ ID NO: 15857 - DNA, 2120 bp, Artificial Sequence; identical to SEQ ID NO: 6752
  Synthetic polypeptide

SEQ ID NO: 15858 - DNA, 1445 bp, Artificial Sequence
  Synthetic polypeptide
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattga

SEQ ID NO: 15859 - DNA, 1472 bp, Artificial Sequence
  Synthetic polypeptide
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattga

SEQ ID NO: 15860 - DNA, 797 bp, Artificial Sequence
  Synthetic polypeptide
tgtgaaaggaaaataaaatctcaggaccccaaacttactatgacaaagggaaaagttaagcttggaaactgagtcacggaaaaaaactgcttttccttttgttcctaaaccgatagctgcaagatagaaagcaacatatgcccccaggtggcctccctcaccctggcaatggaaacgaacagccgagcttcaccggacaagactagaaatcgttcctccacccacccagagacaaagcatatttgacttcttcctctactggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctga

SEQ ID NO: 15861 - DNA, 732 bp, Artificial Sequence
  Synthetic polypeptide
caggaatctcaaagagctatccacacttccatgttcatcatagcattatttaccatagccaaggagccccgcggcctaagcgcagcgtctccgcccttggctgagactggcgctcctcgccgcttccggcggtcagtgccccgaggtgaggcggcgggggcggtgcaggagctggcgcgggcgctggcgcatctgctggaggccgaacgtcaggagcgggcgcgggccgaggcgcaggaggctgaggatcagcaggcgcgcgtcctggcgcagctgctgcgcgtctggggcgccccccgcaactctgatccggctctgggcctggacgacgaccccgacgcgcctgcagcgcagctcgctcgcgctctgctccgcgcccgccttgaccctgccgccctcgcagcccagcttgtccccgcgcccgtccccgccgcggcgctccgaccccggcccccggtctacgacgacggccccgcgggcccggatgctgaggaggcaggcgacgagacacccgacgtggaccccgagctgttgaggtacttgctgggacggattcttgcgggaagcgcggactccgagggggtggcagccccgcgccgcctccgccgtgccgccgaccacgatgtgggctctgagctgccccctgagggcgtgctgggggcgctgctgcgtgtgaaacgcctagagaccccggcgccccaggtgcctgcacgccgcctcttgccaccctga

SEQ ID NO: 15862 - DNA, 4417 bp, Artificial Sequence; identical to SEQ ID NO: 8392
  Synthetic polypeptide

SEQ ID NO: 15863 - DNA, 810 bp, Artificial Sequence
  Synthetic polypeptide
ccctgctacttcaagagggtgttggaccagcagcattcgtatcatctgggagatggctgcaaagacagtatctaagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15864 - DNA, 3963 bp, Artificial Sequence
  Synthetic polypeptide
caggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaa

SEQ ID NO: 15865 - DNA, 707 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaa

SEQ ID NO: 15866 - DNA, 575 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaa

SEQ ID NO: 15867 - DNA, 542 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 15868 - DNA, 533 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcc

SEQ ID NO: 15869 - DNA, 434 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaaccca

SEQ ID NO: 15870 - DNA, 337 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggg

SEQ ID NO: 15871 - DNA, 188 bp, Artificial Sequence
  Synthetic polypeptide
caggggtccccaatccccgggccatggagcagtaccggtctgtggcctgttagaaactgggctgcacatcaagaggttccaatcttcgtgttcactttaagaacactcgtgaaactgctcaggccatcaagggtatgcatatacgaaaagccacgaagtatctgaaagatgtcactttacagaaacag

SEQ ID NO: 15872 - DNA, 1327 bp, Artificial Sequence; identical to SEQ ID NO: 6801
  Synthetic polypeptide

SEQ ID NO: 15873 - DNA, 650 bp, Artificial Sequence; identical to SEQ ID NO: 13186
  Synthetic polypeptide

SEQ ID NO: 15874 - DNA, 521 bp, Artificial Sequence; identical to SEQ ID NO: 13187
  Synthetic polypeptide

SEQ ID NO: 15875 - DNA, 524 bp, Artificial Sequence; identical to SEQ ID NO: 13188
  Synthetic polypeptide

SEQ ID NO: 15876 - DNA, 996 bp, Artificial Sequence; identical to SEQ ID NO: 13189
  Synthetic polypeptide

SEQ ID NO: 15877 - DNA, 717 bp, Artificial Sequence; identical to SEQ ID NO: 13190
  Synthetic polypeptide

SEQ ID NO: 15878 - DNA, 404 bp, Artificial Sequence; identical to SEQ ID NO: 13191
  Synthetic polypeptide

SEQ ID NO: 15879 - DNA, 404 bp, Artificial Sequence; identical to SEQ ID NO: 13192
  Synthetic polypeptide

SEQ ID NO: 15880 - DNA, 395 bp, Artificial Sequence; identical to SEQ ID NO: 13193
  Synthetic polypeptide

SEQ ID NO: 15881 - DNA, 280 bp, Artificial Sequence
  Synthetic polypeptide
tctaagctcttgtgtgtttggtttttggccatcgctttcactgctctttaagctcccccagaggagtggagaggtttacacctgccaagtggagcacccaagcgtgacaagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctga

SEQ ID NO: 15882 - DNA, 749 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaa

SEQ ID NO: 15883 - DNA, 617 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaa

SEQ ID NO: 15884 - DNA, 584 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaa

SEQ ID NO: 15885 - DNA, 575 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcc

SEQ ID NO: 15886 - DNA, 476 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaaccca

SEQ ID NO: 15887 - DNA, 379 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaaggg

SEQ ID NO: 15888 - DNA, 230 bp, Artificial Sequence
  Synthetic polypeptide
caggggtccccaatccccgggccatggagcagtaccggtctgtggcctgttagaaactgggctgcacatcaagaggtgagcctgtggcctgttaggaatcgggctgcacatcaagaggttccaatcttcgtgttcactttaagaacactcgtgaaactgctcaggccatcaagggtatgcatatacgaaaagccacgaagtatctgaaagatgtcactttacagaaacag

SEQ ID NO: 15889 - DNA, 309 bp, Artificial Sequence; identical to SEQ ID NO: 8320
  Synthetic polypeptide

SEQ ID NO: 15890 - DNA, 282 bp, Artificial Sequence
  Synthetic polypeptide
aggcccatcagctgactttaaagataggaaggttatcctggattgtcttgtctagctctggacttattggacaaaatgttgacattcaacccacacaagaggattgaagtagaacaggctctggcccacccatatctggagcagtattacgacccgagtgacgagcccatcgccgaagcaccattcaagttcgacatggaattggatgacttgcctaaggaaaagctcaaagaactaatttttgaagagactgctagattccagccaggatacagatcttaa

SEQ ID NO: 15891 - DNA, 1232 bp, Artificial Sequence; identical to SEQ ID NO: 6566
  Synthetic polypeptide

SEQ ID NO: 15892 - DNA, 497 bp, Artificial Sequence; identical to SEQ ID NO: 6567
  Synthetic polypeptide

SEQ ID NO: 15893 - DNA, 575 bp, Artificial Sequence; identical to SEQ ID NO: 6568
  Synthetic polypeptide

SEQ ID NO: 15894 - DNA, 646 bp, Artificial Sequence; identical to SEQ ID NO: 7772
  Synthetic polypeptide

SEQ ID NO: 15895 - DNA, 304 bp, Artificial Sequence; identical to SEQ ID NO: 7773
  Synthetic polypeptide

SEQ ID NO: 15896 - DNA, 619 bp, Artificial Sequence; identical to SEQ ID NO: 7774
  Synthetic polypeptide

SEQ ID NO: 15897 - DNA, 523 bp, Artificial Sequence; identical to SEQ ID NO: 7775
  Synthetic polypeptide

SEQ ID NO: 15898 - DNA, 441 bp, Artificial Sequence; identical to SEQ ID NO: 7776
  Synthetic polypeptide

SEQ ID NO: 15899 - DNA, 167 bp, Artificial Sequence; identical to SEQ ID NO: 7777
  Synthetic polypeptide

SEQ ID NO: 15900 - DNA, 1217 bp, Artificial Sequence
  Synthetic polypeptide
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacagaaaaccagtctatccaagaccaggcacctatgttggaaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15901 - DNA, 1178 bp, Artificial Sequence
  Synthetic polypeptide
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15902 - DNA, 1133 bp, Artificial Sequence
  Synthetic polypeptide
gccacgcatggtggttcatgcctgcaatcccagcactttgggaggctgaagttaggaggattgcttgaggtgaagagtttgaccccagcctggggaacaaaggaagacgccatctctacaaaagaaaaatgtaaaaattagcttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtcctcagaatggttggaatgaccctccagctttgaacagagtacccaaaaagaagaagatgcctgaaaacttcatgcctcctgttcccatcacatcaccaatcatgaacccgttgggtgacccccagtcacaaatgctgcagcaacagccttcagctccagtaccactgtcaagccagtcttcattcccacagccacatcttccaggtggccagcccttccatggcgtacagcaacctcttggtcaaacaggcatgccaccatctttttcaaagcccaatattgaaggtgccccaggggctcctattggaaataccttccagcatgtgcagtctttgccaacaaaaaaaattaccaagaaacctattccagatgagcacctcattctaaagaccacatttgaggatcttattcagcgctgcctttcttcagcaacagaccctcaaaccaagaggaagctagatgatgccagcaaacgtttggagtttctgtatgataaacttagggaacagacactttcaccaacaatcaccagtggtttacacaacattgcaaggagcattgaaactcgaaactactcagaaggattgaccatgcatacccacatagttagcaccagcaacttcagtgagacctctgctttcatgccagttctcaaagttgttctcacccaggccaataagctgggtgtctaa

SEQ ID NO: 15903 - DNA, 2419 bp, Artificial Sequence; identical to SEQ ID NO: 7455
  Synthetic polypeptide

SEQ ID NO: 15904 - DNA, 1756 bp, Artificial Sequence; identical to SEQ ID NO: 11056
  Synthetic polypeptide

SEQ ID NO: 15905 - DNA, 2825 bp, Artificial Sequence; identical to SEQ ID NO: 6727
  Synthetic polypeptide

SEQ ID NO: 15906 - DNA, 337 bp, Artificial Sequence; identical to SEQ ID NO: 6393
  Synthetic polypeptide

SEQ ID NO: 15907 - DNA, 1022 bp, Artificial Sequence; identical to SEQ ID NO: 590
  Synthetic polypeptide

SEQ ID NO: 15908 - DNA, 347 bp, Artificial Sequence; identical to SEQ ID NO: 591
  Synthetic polypeptide

SEQ ID NO: 15909 - DNA, 1109 bp, Artificial Sequence; identical to SEQ ID NO: 592
  Synthetic polypeptide

SEQ ID NO: 15910 - DNA, 85 bp, Artificial Sequence; identical to SEQ ID NO: 601
  Synthetic polypeptide

SEQ ID NO: 15911 - DNA, 269 bp, Artificial Sequence; identical to SEQ ID NO: 600
  Synthetic polypeptide

SEQ ID NO: 15912 - DNA, 459 bp, Artificial Sequence; identical to SEQ ID NO: 8555
  Synthetic polypeptide

SEQ ID NO: 15913 - DNA, 871 bp, Artificial Sequence; identical to SEQ ID NO: 437
  Synthetic polypeptide

SEQ ID NO: 15914 - DNA, 421 bp, Artificial Sequence; identical to SEQ ID NO: 441
  Synthetic polypeptide

SEQ ID NO: 15915 - DNA, 638 bp, Artificial Sequence; identical to SEQ ID NO: 442
  Synthetic polypeptide

SEQ ID NO: 15916 - DNA, 337 bp, Artificial Sequence; identical to SEQ ID NO: 443
  Synthetic polypeptide

SEQ ID NO: 15917 - DNA, 1033 bp, Artificial Sequence; identical to SEQ ID NO: 7576
  Synthetic polypeptide

SEQ ID NO: 15918 - DNA, 1048 bp, Artificial Sequence; identical to SEQ ID NO: 7577
  Synthetic polypeptide

SEQ ID NO: 15919 - DNA, 966 bp, Artificial Sequence
  Synthetic polypeptide
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacccgtctggcgaagaagcttctcggctggttgcttttcaagacccccgatgaaggagcgtggacttccatctacgcagcagtcaccccagagctggaaggagttggtggccattacctatacaacgagaaagagaccaagtccctccacgtcacctacaaccagaaactgcagcagcagctgtggtctaagagttgtgagatgactggggtccttgatgtgaccctgtga

SEQ ID NO: 15920 - DNA, 738 bp, Artificial Sequence
  Synthetic polypeptide
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacgtctacaagcacgtgttctgggccacc

SEQ ID NO: 15921 - DNA, 539 bp, Artificial Sequence
  Synthetic polypeptide
atgggatggctgtgtccccacccacatggcacctggaattgtaatgattcccacctgtgaagggtggggccaggtggaggaaattgaatcatgggcgcggtgacccgcatactgttctcgtggtagtgagtgtgttctcacgagatctgatgttttataaatggaagttcccctacaggagccattttgcctgccgccgtggaagatatggttttcgtcttccgtcgtgattgtgaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgc

SEQ ID NO: 15922 - DNA, 12210 bp, Artificial Sequence
  Synthetic polypeptide
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 15923 - DNA, 1455 bp, Artificial Sequence
  Synthetic polypeptide
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 15924 - DNA, 1275 bp, Artificial Sequence
  Synthetic polypeptide
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaaggaataccagaaacacatggaaacttttgac

SEQ ID NO: 15925 - DNA, 3495 bp, Artificial Sequence
  Synthetic polypeptide
aatttgggggctcacccaggattgcccctgtggctacctgcctgttgtttggtggccccctttcagtgatggatccagaaggcagcccaagtggctgcctaattctcttggactgggggctgactctgttactctgtctactggtggggtattccaacccaatgtgcgtggacttaattgcaatggaaaaatagtcatggggagatgtcccttaactgtagccctattacagggtatctgtagcctcatggtggggtgtctatctgtagctccgttttggggtgtctggattggtgagtatcctaggtgctgccaatgcctgcttcattctcctgactggttctgtagccctatggtggggtgtctgtagccccattgtggggtgtctgtagatccagcatggggtgtctctgtctgttactccattgtggggtgtctgttcagctcctgggaggtctcagttcgctctttctaactagtaggaagactactggtttgggagacttctcttcaatcaggaagattttgaggaggtttctcatacagaaaataggaggatagtttggaagggatactcttggacttcttggttagggatctgatttggaaggccttctgtccctcttgtctttgcatgtgtttaaatatgtgaaagggatctcagaaggggttgctgatagaagtccagcatgcctaactcagagaaccctccttatttgtctggtcacattcagtgagctctaaagaaggctcaacagtcctgtctctcagggtgactatctgctctttcccttgcccagagacctcattgtgaattaccgttcagaggtcatccgtccccacctggtgtggatcaaagacaacagggaccaagatgaaaaattttgagctttgccaggctgatattgggtgcggaaagaggtgactaatgtctgttttgttatgtgtattttgctgggttggaaaatgttaattcagttccccatgcagcccgttgggcagaatcttgcaaattaagaatcttgtttatggttccataaaatggtaaagggtgattttatcttgtaaagtggcttaaaccccacagctatagcacaagcaagcagggtcgtaagacgccactccgttcttctggaagctgcagagaaagggaacccagaaacctggcatcccagcaataaggatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaa

SEQ ID NO: 15926 - DNA, 648 bp, Artificial Sequence; identical to SEQ ID NO: 12806
  Synthetic polypeptide

SEQ ID NO: 15927 - DNA, 405 bp, Artificial Sequence; identical to SEQ ID NO: 12807
  Synthetic polypeptide

SEQ ID NO: 15928 - DNA, 627 bp, Artificial Sequence; identical to SEQ ID NO: 12808
  Synthetic polypeptide

SEQ ID NO: 15929 - DNA, 411 bp, Artificial Sequence; identical to SEQ ID NO: 12809
  Synthetic polypeptide

SEQ ID NO: 15930 - DNA, 570 bp, Artificial Sequence; identical to SEQ ID NO: 12810
  Synthetic polypeptide

SEQ ID NO: 15931 - DNA, 742 bp, Artificial Sequence; identical to SEQ ID NO: 6357
  Synthetic polypeptide

SEQ ID NO: 15932 - DNA, 590 bp, Artificial Sequence; identical to SEQ ID NO: 6358
  Synthetic polypeptide

SEQ ID NO: 15933 - DNA, 577 bp, Artificial Sequence; identical to SEQ ID NO: 6359
  Synthetic polypeptide

SEQ ID NO: 15934 - DNA, 430 bp, Artificial Sequence; identical to SEQ ID NO: 6360
  Synthetic polypeptide

SEQ ID NO: 15935 - DNA, 670 bp, Artificial Sequence; identical to SEQ ID NO: 6361
  Synthetic polypeptide

SEQ ID NO: 15936 - DNA, 897 bp, Artificial Sequence
  Synthetic polypeptide
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggagggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 15937 - DNA, 893 bp, Artificial Sequence; identical to SEQ ID NO: 12957
  Synthetic polypeptide

SEQ ID NO: 15938 - DNA, 959 bp, Artificial Sequence; identical to SEQ ID NO: 12958
  Synthetic polypeptide

SEQ ID NO: 15939 - DNA, 1028 bp, Artificial Sequence; identical to SEQ ID NO: 12959
  Synthetic polypeptide

SEQ ID NO: 15940 - DNA, 887 bp, Artificial Sequence; identical to SEQ ID NO: 12960
  Synthetic polypeptide

SEQ ID NO: 15941 - DNA, 163 bp, Artificial Sequence; identical to SEQ ID NO: 480
  Synthetic polypeptide

SEQ ID NO: 15942 - DNA, 104 bp, Artificial Sequence; identical to SEQ ID NO: 481
  Synthetic polypeptide

SEQ ID NO: 15943 - DNA, 1629 bp, Artificial Sequence; identical to SEQ ID NO: 8070
  Synthetic polypeptide

SEQ ID NO: 15944 - DNA, 1500 bp, Artificial Sequence; identical to SEQ ID NO: 8071
  Synthetic polypeptide

SEQ ID NO: 15945 - DNA, 829 bp, Artificial Sequence; identical to SEQ ID NO: 624
  Synthetic polypeptide

SEQ ID NO: 15946 - DNA, 1331 bp, Artificial Sequence; identical to SEQ ID NO: 550
  Synthetic polypeptide

SEQ ID NO: 15947 - DNA, 1028 bp, Artificial Sequence; identical to SEQ ID NO: 551
  Synthetic polypeptide

SEQ ID NO: 15948 - DNA, 1295 bp, Artificial Sequence; identical to SEQ ID NO: 553
  Synthetic polypeptide

SEQ ID NO: 15949 - DNA, 1322 bp, Artificial Sequence; identical to SEQ ID NO: 554
  Synthetic polypeptide

SEQ ID NO: 15950 - DNA, 1013 bp, Artificial Sequence; identical to SEQ ID NO: 555
  Synthetic polypeptide

SEQ ID NO: 15951 - DNA, 139 bp, Artificial Sequence; identical to SEQ ID NO: 8939
  Synthetic polypeptide

SEQ ID NO: 15952 - DNA, 368 bp, Artificial Sequence; identical to SEQ ID NO: 8940
  Synthetic polypeptide

SEQ ID NO: 15953 - DNA, 2192 bp, Artificial Sequence; identical to SEQ ID NO: 8941
  Synthetic polypeptide

SEQ ID NO: 15954 - DNA, 1328 bp, Artificial Sequence; identical to SEQ ID NO: 8942
  Synthetic polypeptide

SEQ ID NO: 15955 - DNA, 2117 bp, Artificial Sequence; identical to SEQ ID NO: 8943
  Synthetic polypeptide

SEQ ID NO: 15956 - DNA, 1265 bp, Artificial Sequence; identical to SEQ ID NO: 8944
  Synthetic polypeptide

SEQ ID NO: 15957 - DNA, 1331 bp, Artificial Sequence; identical to SEQ ID NO: 8945
  Synthetic polypeptide

SEQ ID NO: 15958 - DNA, 1365 bp, Artificial Sequence; identical to SEQ ID NO: 8252
  Synthetic polypeptide

SEQ ID NO: 15959 - DNA, 503 bp, Artificial Sequence; identical to SEQ ID NO: 493
  Synthetic polypeptide

SEQ ID NO: 15960 - DNA, 476 bp, Artificial Sequence; identical to SEQ ID NO: 495
  Synthetic polypeptide

SEQ ID NO: 15961 - DNA, 539 bp, Artificial Sequence; identical to SEQ ID NO: 496
  Synthetic polypeptide

SEQ ID NO: 15962 - DNA, 792 bp, Artificial Sequence; identical to SEQ ID NO: 6418
  Synthetic polypeptide

SEQ ID NO: 15963 - DNA, 369 bp, Artificial Sequence; identical to SEQ ID NO: 6419
  Synthetic polypeptide

SEQ ID NO: 15964 - DNA, 249 bp, Artificial Sequence; identical to SEQ ID NO: 6420
  Synthetic polypeptide

SEQ ID NO: 15965 - DNA, 369 bp, Artificial Sequence; identical to SEQ ID NO: 6421
  Synthetic polypeptide

SEQ ID NO: 15966 - DNA, 843 bp, Artificial Sequence; identical to SEQ ID NO: 6422
  Synthetic polypeptide

SEQ ID NO: 15967 - DNA, 1833 bp, Artificial Sequence; identical to SEQ ID NO: 8747
  Synthetic polypeptide

SEQ ID NO: 15968 - DNA, 1755 bp, Artificial Sequence; identical to SEQ ID NO: 8748
  Synthetic polypeptide

SEQ ID NO: 15969 - DNA, 2120 bp, Artificial Sequence; identical to SEQ ID NO: 6752
  Synthetic polypeptide

SEQ ID NO: 15970 - DNA, 1148 bp, Artificial Sequence; identical to SEQ ID NO: 436
  Synthetic polypeptide

SEQ ID NO: 15971 - DNA, 1360 bp, Artificial Sequence; identical to SEQ ID NO: 7956
  Synthetic polypeptide

SEQ ID NO: 15972 - DNA, 1222 bp, Artificial Sequence; identical to SEQ ID NO: 7957
  Synthetic polypeptide

SEQ ID NO: 15973 - DNA, 80 bp, Artificial Sequence; identical to SEQ ID NO: 6364
  Synthetic polypeptide

SEQ ID NO: 15974 - DNA, 217 bp, Artificial Sequence; identical to SEQ ID NO: 6365
  Synthetic polypeptide

SEQ ID NO: 15975 - DNA, 158 bp, Artificial Sequence; identical to SEQ ID NO: 7602
  Synthetic polypeptide

SEQ ID NO: 15976 - DNA, 665 bp, Artificial Sequence; identical to SEQ ID NO: 6374
  Synthetic polypeptide

SEQ ID NO: 15977 - DNA, 518 bp, Artificial Sequence; identical to SEQ ID NO: 6375
  Synthetic polypeptide

SEQ ID NO: 15978 - DNA, 423 bp, Artificial Sequence; identical to SEQ ID NO: 6550
  Synthetic polypeptide

SEQ ID NO: 15979 - DNA, 934 bp, Artificial Sequence
  Synthetic polypeptide
gtagacagactctcccagtgattccagcctcctggcactgacatcccctacccttgagtgtggacaggacctgtttcttgattctagccaagggaatatggcaaagatgataaaatatcactcccatgattatgttactatatacttatatatatgtatctgtcttgctagcaggcccactgtagggactctttctctctggccctgaaggagcaaacagtcatgaagtaagtggttggaggagggagaagcccaccttttaaggaacttggggcagcttctaggagccgaacgtggcctccagcaagaaactgaatcactcagtcctgcagccaccagaaatgaattctgccagcagtctgagtgaggttggcagtaaattctcccccggtggagcctccagaacaacatagcagaagtcagagagctctcttccaagctggtgaccgaagatgtgctgaagcatatcaacagtttactctgtagcagggaaatggaagtcagctattttgctgcaggtatcatagcccacctgacatctgacagacagctttggatatcccgtgacttccagaggcgtactcttctccaagatctgcatgcaaccatacagaattggccaagttcaagttgtaagatgacagcattggtgacctatagatctttcaagacatttttcccgctccttggcaacttctctcaaccagaggttcagctctgggcactatgggctatgtatcatgtctgcagtaaaaatcccagcaaatactgcaaaatgttagttgaagaagaaggattgcagcttttgtgtgatatccaggagcacagtgaggcaacccccaaagcacagcagattgcagcctccattctggatgacttcagaatgcatttcatgaattatcagaggcccactctgtgtcaaatgcccttctga

SEQ ID NO: 15980 - DNA, 811 bp, Artificial Sequence; identical to SEQ ID NO: 7500
  Synthetic polypeptide

SEQ ID NO: 15981 - DNA, 1452 bp, Artificial Sequence; identical to SEQ ID NO: 7300
  Synthetic polypeptide

SEQ ID NO: 15982 - DNA, 1149 bp, Artificial Sequence; identical to SEQ ID NO: 7301
  Synthetic polypeptide

SEQ ID NO: 15983 - DNA, 1416 bp, Artificial Sequence; identical to SEQ ID NO: 7302
  Synthetic polypeptide

SEQ ID NO: 15984 - DNA, 1443 bp, Artificial Sequence; identical to SEQ ID NO: 7303
  Synthetic polypeptide

SEQ ID NO: 15985 - DNA, 1134 bp, Artificial Sequence; identical to SEQ ID NO: 7304
  Synthetic polypeptide

SEQ ID NO: 15986 - DNA, 3380 bp, Artificial Sequence; identical to SEQ ID NO: 12414
  Synthetic polypeptide

SEQ ID NO: 15987 - DNA, 3584 bp, Artificial Sequence; identical to SEQ ID NO: 12415
  Synthetic polypeptide

SEQ ID NO: 15988 - DNA, 2672 bp, Artificial Sequence; identical to SEQ ID NO: 6621
  Synthetic polypeptide

SEQ ID NO: 15989 - DNA, 1767 bp, Artificial Sequence; identical to SEQ ID NO: 6622
  Synthetic polypeptide

SEQ ID NO: 15990 - DNA, 1692 bp, Artificial Sequence; identical to SEQ ID NO: 6623
  Synthetic polypeptide

SEQ ID NO: 15991 - DNA, 1201 bp, Artificial Sequence
  Synthetic polypeptide
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaa

SEQ ID NO: 15992 - DNA, 919 bp, Artificial Sequence
  Synthetic polypeptide
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattaggatcgtga

SEQ ID NO: 15993 - DNA, 776 bp, Artificial Sequence
  Synthetic polypeptide
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccc

SEQ ID NO: 15994 - DNA, 601 bp, Artificial Sequence
  Synthetic polypeptide
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcct

SEQ ID NO: 15995 - DNA, 306 bp, Artificial Sequence
  Synthetic polypeptide
cagccatgcactgcataaccatgttttggtcaatcacaccacctgtgtgatggtggtgccattacaaatataatggagctgaaacatttctgtctcctggtgacatagtagctgtcataatgtcatagcacagtttatttttttttataaatgtagcctaaatgtatggtgtgtttagtgtacagtagtgtatacagtaatgtcctaggccttcgtattcactcaccacttaatcactaactcacccaaagcaactttcagtcctgcaagctccatttatgattgggcctgggaagctgtgaatcc

SEQ ID NO: 15996 - DNA, 1005 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgccgccacgcctgactggttttcgttttttttttggtggagacggggttttgctgtgttggccgggctggtctccagctcctaaccgcgagtgatccgccagcctcggcctccctaggtgccgggattgcagacggagtctcgttcactcagtgctcaatggtgcccaggctggagtgcagtggcgtgatctcggctcgctacaaccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttcgccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaactctctgcctggcaaccgccccgtctgagaagtgaggagcccctccgtccggcagccatcccgtctgggaagtgaggagcccctccgcctggcagccaccccgtctggaaacggatctgaaaagaacaattgctgtccttctggatgacattttgcaacgattggtgaagctggagaacaaagttgactatattgttgtgaatggctcagcagccaacaccaccaatggtactagtgggaatttggtgccagtaaccacaaataaaagaacgaatgtctcgggcagtatcagatag

SEQ ID NO: 15997 - DNA, 914 bp, Artificial Sequence
  Synthetic polypeptide
ctccttccacggtctccctctgatgccgagccaaagctggacggtactgctgccatctcggctcactgcaacctccctgcctgattctcctgcctcagcctgccgagtgccgccacgcctgactggttttcgttttttttttggtggagacggggttttgctgtgttggccgggctggtctccagctcctaaccgcgagtgatccgccagcctcggcctccctaggtgccgggattgcagacggagtctcgttcactcagtgctcaatggtgcccaggctggagtgcagtggcgtgatctcggctcgctacaaccacctcccagccgcctgccttggccccccaaagtgccgagattgcagcctctgcccagccgccaccccgtctgggaagtgaggagcgtctctgcctggccccccatcgtctgggatatgaggagcctctctgcctggctgcccagtctggaaagtgaggagcgtctctgcccggccgccatcccatctaggaagcgaggagcgcctcttcgccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaactctctgcctggcaaccgccccgtctgagaagtgaggagcccctccgtccggcagccatcccgtctgggaagtgaggagcccctccgcctggcagccaccccgtctggaaacggatctgaaaagaacaattgctgtccttctggatgacattttgcaacgattggtgaagctggagaacaaagttgactatattgttgtgaatgg

SEQ ID NO: 15998 - DNA, 2448 bp, Artificial Sequence; identical to SEQ ID NO: 6618
  Synthetic polypeptide

SEQ ID NO: 15999 - DNA, 1543 bp, Artificial Sequence; identical to SEQ ID NO: 6619
  Synthetic polypeptide

SEQ ID NO: 16000 - DNA, 1468 bp, Artificial Sequence; identical to SEQ ID NO: 6620
  Synthetic polypeptide

SEQ ID NO: 16001 - DNA, 863 bp, Artificial Sequence
  Synthetic polypeptide
tttgcagagagttttaaaaacaaaagaaaatgcctgtggcattatgttgactggaaaaaacaagttccacattgtatatatgggatgttctcaactgtgcttaagtctggaaggaaatctgccaggaggttgacagtagctgcttctagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaag

SEQ ID NO: 16002 - DNA, 2174 bp, Artificial Sequence
  Synthetic polypeptide
tttgcagagagttttaaaaacaaaagaaaatgcctgtggcattatgttgactggaaaaaacaagttccacattgtatatatgggatgttctcaactgtgcttaagtctggaaggaaatctgccaggaggttgacagtagctgcttctagtttcctccagcttatggaggcatatctgaggtgaatcaacctgccgaattgatgccccagttttctacaattgagtacgtgatacagcgaggtgctcagtcccctctgatctttctctatgtggttgacacatgcctggaggaagatgaccttcaagcactcaaagagtccctgcagatgtccctgagtcttcttcctccagatgctctggtgggtctgatcacatttggaaggatggtgcaggttcatgagctaagctgtgaaggaatctccaaaagttatgtcttccgagggaccaaggatttaactgcaaagcaaatacaggatatgttgggcctgaccaagccagccatgcccatgcagcaagcacgacctgcacaaccacaggagcacccttttgcttcaagcagatttctgcagcctgttcacaagattgatatgaacctcactgatcttcttggggagctacagagggacccatggccagtaactcaggggaagagacctttgcgatccactggtgtggctttgtccattgctgttggcttgctggagggcacttttccaaacacaggagccaggatcatgctgtttactggaggtccccctacccaagggcctggcatggtggttggagatgaattaaagattcctattcgttcttggcatgatattgagaaagataatgcacgattcatgaaaaaggcaaccaagcactatgagatgcttgctaatcgaacagctgcaaatggtcactgcattgatatttatgcttgtgcccttgatcaaactggacttttggagatgaagtgttgtgcaaatcttactggaggctacatggtaatgggagattctttcaacacttctctcttcaagcagacattccaaagaatctttactaaagattttaatggagatttccgaatggcatttggtgctactttggacgtaaagacctctcgggaactgaagattgcaggagccattggtccatgcgtatctctgaatgtgaaaggaccgtgtgtgtcagaaaatgagcttggtgttggtggcacgagtcagtggaaaatctgtggcctagatcctacatctacacttggcatctattttgaagttgtcaatcagcacaacaccccgatcccccaaggaggcagaggagccatccagtttgtcacgcattatcagcactccagcacccagagacgcatccgcgtgaccaccatcgcccgaaattgggcagatgtacagagtcagctcaggcacatagaagcagcatttgaccaggaggctgcggcagtgttgatggcacggcttggggtgttccgagcggagtcagaggaggggcccgatgtgctccggtggctggaccgacaactcatccgactgtgtcaaaagtttggacagtataacaaagaagaccccacttcttttaggttatcagattccttttctctatatcctcagtttatgttccatctgagaagatctccatttcttcaagtgtttaacaacagtcctgatgagtcgtcatattacagacatcattttgcccggcaggacctgacccagtccctcatcatgatccagcccattctctactcttactcctttcatgggccaccagagccagtactcttggatagcagcagcattctagctgacagaattttgctgatggatactttctttcaaattgtcatttatcttggtgagaccatagcccagtggcgtaaagctggctaccaggacatgcccgagtatgaaaacttcaagcaccttctgcaggcaccactggatgatgctcaagaaattctgcaagcacgcttcccgatgccacgttacatcaacacggagcatggaggcagtcaggctcgattccttttgtccaaagtgaacccatctcagacacacaataacctgtatgcttggggacaggaaactggagcacccatcctaactgatgatgttagcctgcaggtgttcatggaccatttgaagaagctggctgtctccagtgcctgttaa

SEQ ID NO: 16003 - DNA, 625 bp, Artificial Sequence; identical to SEQ ID NO: 6804
  Synthetic polypeptide

SEQ ID NO: 16004 - DNA, 598 bp, Artificial Sequence; identical to SEQ ID NO: 6805
  Synthetic polypeptide

SEQ ID NO: 16005 - DNA, 119 bp, Artificial Sequence; identical to SEQ ID NO: 6582
  Synthetic polypeptide

SEQ ID NO: 16006 - DNA, 462 bp, Artificial Sequence
  Synthetic polypeptide
ggctggatgctgtggctcacgcctgtaatctcagcactttgggaggcagaggcaggcagattacctgaggttgggagttcgagaccagcctgaccaacatggagaaaccccgtctctactaaaaatacaagatagccaggcgtggtggcacatgcctgtaatcccagctactcggtaggctgaagcaggagaagaatcacttgaactcgggaggcggaggttgcagtgagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctga

SEQ ID NO: 16007 - DNA, 612 bp, Artificial Sequence
  Synthetic polypeptide
ggctggatgctgtggctcacgcctgtaatctcagcactttgggaggcagaggcaggcagattacctgaggttgggagttcgagaccagcctgaccaacatggagaaaccccgtctctactaaaaatacaagatagccaggcgtggtggcacatgcctgtaatcccagctactcggtaggctgaagcaggagaagaatcacttgaactcgggaggcggaggttgcagtgagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaa

SEQ ID NO: 16008 - DNA, 1767 bp, Artificial Sequence; identical to SEQ ID NO: 7857
  Synthetic polypeptide

SEQ ID NO: 16009 - DNA, 1764 bp, Artificial Sequence; identical to SEQ ID NO: 7858
  Synthetic polypeptide

SEQ ID NO: 16010 - DNA, 630 bp, Artificial Sequence; identical to SEQ ID NO: 7859
  Synthetic polypeptide

SEQ ID NO: 16011 - DNA, 303 bp, Artificial Sequence
  Synthetic polypeptide
agtgaagagcacagattgagtcagccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctga

SEQ ID NO: 16012 - DNA, 519 bp, Artificial Sequence
  Synthetic polypeptide
tttgggttcatgttgcctgcattttggtccacgtggctctgtttaatacctgtgtgaccttgtgcaagtctcttaacctctaacctcttgcgcccttagccatacctgtcttgtcggattgctttgaggatgaatgaagcagctgtgtttcgacacttagtgcctggcgtatactgccttggggtgcggtgcaggggtccagagccatgtcggacctgttactgttactactggacctgactctgttactgctgctgatgctgctgggctttgccgggtactcagggcagttggctggggtggcagtgagtgccggctcaccccccatccctacaagttccatgtggagccctatggtgagactgggtggcttctcaccagagctgcagcatctcccccaaactctgctccatcgctgtccactaggacaaccctgcatgggagtgttgacatttagggatgtggccttagaattctctctggaggagtggcaatgcctggacaccgcacagcagaatt

SEQ ID NO: 16013 - DNA, 462 bp, Artificial Sequence
  Synthetic polypeptide
gaggaaacagacacggacttagaggtggtgttggaaaaaaaaggcaacatggatgaggcgcacatagaccaggtgaggcgaaaggccttgcaagaagagatcgatcgcgagtcaggcaaaacggaagcttctgaaaccaggaagtggacgggaacccagtttggccagtgggatactgctggttttgagaacgaggaccaaaaactgaaatttctcagacttatgggtggcttcaaaaacctgtccccttcgttcagccgccccgccagcacgattgcaaggcccaacatggccctcggcaagaaggcggctgacagcctgcagcagaatctgcagcgggactacgaccgggccatgagctggaagtacagccggggagccggcctcggcttctccaccgcccccaacaagatcttttacattgacaggaacgcttccaagtcagtcaagctggaagattaa

SEQ ID NO: 16014 - DNA, 2099 bp, Artificial Sequence
  Synthetic polypeptide
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataa

SEQ ID NO: 16015 - DNA, 1433 bp, Artificial Sequence
  Synthetic polypeptide
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttga

SEQ ID NO: 16016 - DNA, 2039 bp, Artificial Sequence
  Synthetic polypeptide
aagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactgtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattag

SEQ ID NO: 16017 - DNA, 376 bp, Artificial Sequence; identical to SEQ ID NO: 10759
  Synthetic polypeptide

SEQ ID NO: 16018 - DNA, 2167 bp, Artificial Sequence
  Synthetic polypeptide
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16019 - DNA, 1942 bp, Artificial Sequence
  Synthetic polypeptide
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16020 - DNA, 2110 bp, Artificial Sequence
  Synthetic polypeptide
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16021 - DNA, 2113 bp, Artificial Sequence
  Synthetic polypeptide
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16022 - DNA, 1999 bp, Artificial Sequence
  Synthetic polypeptide
gccgagctccgtggctcagacctgtagtcgcagcgctttgagtgagaggatcgcttgggcccaagagtacaaggttacagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16023 - DNA, 1002 bp, Artificial Sequence
  Synthetic polypeptide
ctctcccctctcccttttctcctctcccctctccctctcggtctccctctccctctctttccactgtctccctctgatgccgagccgaagctggactgtactgctgccatctcggctcactgcaacctccctgcctgattctcctgcctcagcctgccgagtgcctgcgattgcaggcgcgcgccaccacgcctgactggttttcgtacttttttggtggagacggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgcctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccatctgggatgtgaggagcgcctctgccaggccgcgaccccgtctgggaggtgaggagcgtctctgcccagccgccccgtctgagaagtgaggagaccctccgcccagcatccgccccatctgagaagtgaggagcccctccgcccggcagctgccccgtctgagaagtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaa

SEQ ID NO: 16024 - DNA, 455 bp, Artificial Sequence; identical to SEQ ID NO: 7734
  Synthetic polypeptide

SEQ ID NO: 16025 - DNA, 873 bp, Artificial Sequence; identical to SEQ ID NO: 6614
  Synthetic polypeptide

SEQ ID NO: 16026 - DNA, 207 bp, Artificial Sequence; identical to SEQ ID NO: 6615
  Synthetic polypeptide

SEQ ID NO: 16027 - DNA, 2231 bp, Artificial Sequence
  Synthetic polypeptide
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16028 - DNA, 2006 bp, Artificial Sequence
  Synthetic polypeptide
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16029 - DNA, 2174 bp, Artificial Sequence
  Synthetic polypeptide
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16030 - DNA, 2177 bp, Artificial Sequence
  Synthetic polypeptide
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16031 - DNA, 2063 bp, Artificial Sequence
  Synthetic polypeptide
aggttgagtatcccaaatttaaaaatccagagtccgaaatgctcaaaaacccaaaactatttgcatgtcaacatgatgctcaaaggaaatgctcattggagtattttggattttggactttccggattccagatgctcaaccagtctaccctgaactgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16032 - DNA, 60 bp, Artificial Sequence
  Synthetic polypeptide
catgctcctccacaggtcaacaggaagggatacatctactcaacaaacttcgggatttag

SEQ ID NO: 16033 - DNA, 3364 bp, Artificial Sequence
  Synthetic polypeptide
ggctgggtgcagtggcttacgtctgtaattccagcactttggaaagctgagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcagacatgtgctattagttggccactgctacaaaaatgcaacgatgtgataaatgcaaaatcaatctgcagacttgcttggcagccaaaaagtgggaagttactggcaattcctgtggaaaaatctgttaagctatatagaagagaatcttggagtcatcaatttgatctttcagataatttcatctctcagaccctcaatatagtaacctggtctccctgtgggcaatatttagctgcaggtagtattaatggtctaatcatagtttggaatgtggaaaccaaagactgcatggaaagggtgaaacatgagaaaggttatgcaatttgtggtctggcatggcatcctacttgtggtcgaatatcgtatactgatgcggaaggaaatctagggcttctagagaatgtttgtgaccccagtggaaagacatcaagcagtaaggtatctagcagagtggaaaaggattataatgatctttttgatggagatgatatgagtaatgctggtgattttctaaatgacaatgcagttgagatcccttctttttcaaaagggattataaatgatgatgaggatgatgaagacctcatgatggcttcaggtcgtcctagacagcgaagtcacatcctagaagatgatgaaaactcagttgatatttcaatgctaaaaactggttctagtcttctcaaagaggaggaggaagatggtcaagaaggcagcattcacaatctaccacttgtaacatcccaaaggccattttatgatggacccatgccaactccccggcaaaagccatttcagtcaggttctacaccgttgcatctcactcacagattcatggtgtggaactctattggaattattcgctgctataatgatgagcaagacaatgccatagatgtggagttccatgatacctccatacaccatgcaacacacttatcaaacactttgaattatacaatagcagatctttcccacgaagctattttgttggcatgtgaaagcactgatgaactagcaagcaagcttcactgcctgcactttagttcttgggattcaagcaaagagtggataatagacttgcctcagaatgaggatattgaagccatatgtctcggtcaaggatgggctgctgccgctactagtgccctgcttcttcgattgtttactattggaggggttcaaaaagaggtattcagccttgctggacctgtggtgtcaatggcaggacatggagaacagcttttcattgtttatcacagaggtacaggatttgatggggatcagtgccttggagttcaactgctagagctggggaaaaagaaaaaacaaattttgcatggtgaccctcttcctcttacaaggaaatcctaccttgcatggattgggttttcagctgaaggtaccccttgttacgtggattcagaaggaattgttcgaatgcttaacagaggacttggtaatacgtggactcctatatgtaatacaagagagcactgcaaaggaaaatctgatcactactgggtggttggtatccatgaaaatccccagcaactaaggtgcattccttgtaaaggttctcggtttcccccaacccttccacgccctgctgttgctatattatcctttaagcttccttactgtcagattgcaacagagaaaggacaaatggaggagcaattttggcgttcagttatatttcacaaccaccttgattatttagctaaaaatggttatgaatatgaagagagcactaaaaatcaagcaacaaaagagcaacaggaacttttaatgaaaatgcttgcgctttcttgtaaactggagcgagaattccgttgtgtggaacttgctgatctaatgactcaaaatgctgtgaatttagccattaaatatgcttctcgctctcggaaattaatactggctcaaaaactaagtgaactggctgtagagaaggcagccgaattgacagcaacccaggtggaagaggaagaagaagaagaagatttcagaaaaaagctgaatgctggttacagcaatactgctacagagtggagccaaccaaggttcagaaatcaagttgaagaagatgctgaggacagtggagaagctgatgatgaagaaaaaccagaaatacataagcctggacagaactcgttttccaaaagtacaaattcctctgatgtttcagctaagtcaggtgcagttacctttagcagccaaggacgagtaaatccctttaaggtatcagccagttccaaagaaccagccatgtcaatgaattcagcacgttcaactaatattttagacaatatgggcaaatcatccaagaaatccactgcacttagtcgaactacaaataatgaaaagtctcccattataaagcctctgattccaaagccgaagcctaagcaggcatctgcagcatcctatttccagaaaagaaattctcaaactaataaaactgaggaagtgaaagaagaaaatcttaaaaatgtattatctgaaaccccagctatatgtcctcctcaaaacactgaaaaccaaaggccaaagaccgggttccagatgtggttagaagaaaatagaagtaatattttgtctgacaatcctgacttttcagatgaagcagacataataaaagaaggaatgattcgatttagagtattgtcaactgaagaaagaaaggtgtgggctaacaaagccaaaggagaaacggcaagtgaaggaactgaagcaaagaagcgaaaacgtgtggttgatgaaagtgatgaaacagaaaaccaggaagaaaaagcaaaagagaacctgaatttgtctaaaaagcagaaacctttagatttttctacaaatcagaaactatcagcttttgcatttaagcaggagtaa

SEQ ID NO: 16034 - DNA, 478 bp, Artificial Sequence
  Synthetic polypeptide
ggctgggtgcagtggcttacgtctgtaattccagcactttggaaagctgagttttattgtgacttgtggaagtgatggtgatgtgaggatttgggaagacttggatgatgatgatcctaagttcattaatgttggagaaaaggcatattcatgtgctttgaagagtggaaaactggtcactgcagtttctaataatactattcaagtccacacatttcctgaaggagttccagatggtatattgactcgcttcactacaaatgcaaaccatgtggtctttaatggggatggtactaaaattgctgctggatctagtgattttctagtcaaaattgtggatgtgatggatagcagccaacagaaaacatttcgaggacatgatgcccctgttttaagtctttcctttgatcctaaggacatctttctggcatcagctagttgtgatggatctgtcagagtgtggcaaatttcagatcag

SEQ ID NO: 16035 - DNA, 369 bp, Artificial Sequence; identical to SEQ ID NO: 6492
  Synthetic polypeptide

SEQ ID NO: 16036 - DNA, 4908 bp, Artificial Sequence; identical to SEQ ID NO: 11516
  Synthetic polypeptide

SEQ ID NO: 16037 - DNA, 4611 bp, Artificial Sequence; identical to SEQ ID NO: 11517
  Synthetic polypeptide

SEQ ID NO: 16038 - DNA, 5142 bp, Artificial Sequence; identical to SEQ ID NO: 11518
  Synthetic polypeptide

SEQ ID NO: 16039 - DNA, 777 bp, Artificial Sequence; identical to SEQ ID NO: 11519
  Synthetic polypeptide

SEQ ID NO: 16040 - DNA, 1018 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16041 - DNA, 1807 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16042 - DNA, 2434 bp, Artificial Sequence
  Synthetic polypeptide
gagctgcaggcttgggagtcccacctgcctgcttttgaatcctgtcaagactgtggcttggcacccttgggcatgtgatgtgaccttcctgagcctgcattccctcacctggaaatgatgagcagttactgatgccacagatttggggaagagcctgtgaggtcatgagtgtgcaggccaggctgagcgctctgcgaatattcactggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctga

SEQ ID NO: 16043 - DNA, 382 bp, Artificial Sequence; identical to SEQ ID NO: 434
  Synthetic polypeptide

SEQ ID NO: 16044 - DNA, 330 bp, Artificial Sequence; identical to SEQ ID NO: 7604
  Synthetic polypeptide

SEQ ID NO: 16045 - DNA, 1516 bp, Artificial Sequence; identical to SEQ ID NO: 534
  Synthetic polypeptide

SEQ ID NO: 16046 - DNA, 591 bp, Artificial Sequence; identical to SEQ ID NO: 539
  Synthetic polypeptide

SEQ ID NO: 16047 - DNA, 482 bp, Artificial Sequence; identical to SEQ ID NO: 540
  Synthetic polypeptide

SEQ ID NO: 16048 - DNA, 444 bp, Artificial Sequence; identical to SEQ ID NO: 541
  Synthetic polypeptide

SEQ ID NO: 16049 - DNA, 334 bp, Artificial Sequence; identical to SEQ ID NO: 533
  Synthetic polypeptide

SEQ ID NO: 16050 - DNA, 38 bp, Artificial Sequence; identical to SEQ ID NO: 543
  Synthetic polypeptide

SEQ ID NO: 16051 - DNA, 245 bp, Artificial Sequence; identical to SEQ ID NO: 542
  Synthetic polypeptide

SEQ ID NO: 16052 - DNA, 1218 bp, Artificial Sequence; identical to SEQ ID NO: 8394
  Synthetic polypeptide

SEQ ID NO: 16053 - DNA, 1053 bp, Artificial Sequence; identical to SEQ ID NO: 8395
  Synthetic polypeptide

SEQ ID NO: 16054 - DNA, 942 bp, Artificial Sequence; identical to SEQ ID NO: 8396
  Synthetic polypeptide

SEQ ID NO: 16055 - DNA, 1091 bp, Artificial Sequence; identical to SEQ ID NO: 8397
  Synthetic polypeptide

SEQ ID NO: 16056 - DNA, 926 bp, Artificial Sequence
  Synthetic polypeptide
ggctgggcgtggtggctcacacctgtaatcccagcactttgggaggccgaggcaggcagatcacgaggccaggagttcgagaccagcctagccaacatggtttctttctttacccaaagaaaatttcccaagcttcctcctgcctgcagaagctcctctactttaacctgtctgccatcaaagaaagggaacagttgacattggcccagctgggcctggacttggggcccaattcttactataacctgggaccagagctggaactggctctgttcctggttcaggagcctcatgtgtggggccagaccacccctaagccaggtaaaatgtttgtgttgcggtcagtcccatggccacaaggtgctgttcacttcaacctgctggatgtagctaaggattggaatgacaacccccggaaaaatttcgggttattcctggagatactggtcaaagaagatagagactcaggggtgaattttcagcctgaagacacctgtgccagactaagatgctcccttcatgcttccctgctggtggtgactctcaaccctgatcagtgccacccttctcggaaaaggagagcagccatccctgtccccaagctttcttgtaagaacctctgccaccgtcaccagctattcattaacttccgggacctgggttggcacaagtggatcattgcccccaaggggttcatggcaaattactgccatggagagtgtcccttctcactgaccatctctctcaacagctccaattatgctttcatgcaagccctgatgcatgccgttgacccagagatcccccaggctgtgtgtatccccaccaagctgtctcccatttccatgctctaccaggacaataatgacaatgtcattctacgacattatgaagacatggtagtcgatgaatgtgggtgtgggtag

SEQ ID NO: 16057 - DNA, 1145 bp, Artificial Sequence
  Synthetic polypeptide
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttgatgaaacatgtaaatgaaagatttcaagatgaaaaaaataaagaggttgttctcatgtgcattggcgtcacttcaggagttggacgactgctctttggccggattgcagattatgtgcctggtgtgaagaaggtttatctacaggtactctcctttttcttcattggtctgatgtccatgatgattcctctgtgtagcatctttggggccctcattgctgtgtgcctcatcatgggtctcttcgatggatgcttcatttccattatggctcccatagcctttgagttagttggtgcccaggatgtctcccaagcaattggatttctgctcggattcatgtctatacccatgactgttggcccacccattgcagggttacttcgtgacaaactgggctcctatgatgtggcattctacctcgctggagtccctccccttattggaggtgctgtgctttgttttatcccgtggatccatagtaagaagcaaagagagatcagtaaaaccactggaaaagaaaagatggagaaaatgttggaaaaccagaactctctgctgtcaagttcatctggaatgttcaagaaagaatctgactctattatttaa

SEQ ID NO: 16058 - DNA, 560 bp, Artificial Sequence
  Synthetic polypeptide
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggtgagtatgctccttcactga

SEQ ID NO: 16059 - DNA, 575 bp, Artificial Sequence
  Synthetic polypeptide
aaggatccccaacccctgtgccacagactggtacgggtccatggcctgttaggaattgggctgcacagcaggaggtgagctgtggttccatcgagcctctgtaccttacctatggaatcatatttgcctgcggctgctcctttgcataccagccttcattggtcattttgggacactatttcaagaagcgccttggactggtgaatggcattgtcactgctggcagcagtgtcttcacaatcctgctgcctttgctcttaagggttctgattgacagcgtgggcctcttttacacattgagggtgctctgcatcttcatgtttgttctctttctggctggctttacttaccgacctcttgctaccagtaccaaagataaagagagtggaggtagcggatcctccctcttttccaggaaaaagttcagtcctccaaaaaaaattttcaattttgccatcttcaaggtgacagcttatgcagtgtgggcagttggaataccacttgcactttttggatactttgtgccttatgttcacttggcaaaattcagctttgttatactgaaatacgaataa

SEQ ID NO: 16060 - DNA, 1714 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 16061 - DNA, 1600 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccagactgacattgagattacacgagaggaggacttcacccgaattctccagatggaggaagagtacatccagcagctctgtgaggacattatccaactgaagcccgatgtggtcatcactgaaaagggcatctcagatttagctcagcactaccttatgcgggccaatatcacagccatccgcagagtccggaagacagacaataatcgcattgctagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggccaagcacacccaggagaactgtgagacctggggtgtaaatggtgagacgggtactttggtggacatgaaggaactgggcatatgggagccattggctgtgaagctgcagacttataagacagcagtggagacggcagttctgctactgcgaattgatgacatcgtttcaggccacaaaaagaaaggcgatgaccagagccggcaaggcggggctcctgatgctggccaggagtga

SEQ ID NO: 16062 - DNA, 833 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagcc

SEQ ID NO: 16063 - DNA, 779 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaagatacctggaggcatcattgaagactcctgtgtcttgcgtggagtcatgattaacaaggatgtgacccatccacgtatgcggcgctatatcaagaacc

SEQ ID NO: 16064 - DNA, 570 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaa

SEQ ID NO: 16065 - DNA, 538 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagattcaagtccagcatccagcggccaagtccatgatcgaaattagccggacccaggatgaagaggttggagatgggaccacatcagtaattattcttgcaggggaaatgctgtctgtagctgagcacttcctggagcagcagatgcacccaacagtggtgatcagtgcttaccgcaaggcattggatgatatgatcagcaccctaaagaaaataagtatcccagtcgacatcagtgacagtgatatgatgctgaacatcatcaacagctctattactaccaaagccatcagtcggtggtcatctttggcttgcaacatt

SEQ ID NO: 16066 - DNA, 559 bp, Artificial Sequence
  Synthetic polypeptide
ctagctttatattcttggcccatcccttagtagcggtaatttaaatgtttcaatctgtattacggagttaacagtatttcctagtagaattgtgagaattaaatgaggccagaacacaaagcgtgaatccggaagaaaagttcaatctggaaacatcaatgctgccaagactattgcagatatcatccgaacatgtttgggacccaagtccatgatgaagatgcttttggacccaatgggaggcattgtgatgaccaatgatggcaatgccattcttcgagagattcaagtccagcatccagcggccaagtccatgatcgaaattagccggacccaggatgaagaggttggagatgggaccacatcagtaattattcttgagtctcactctgtcaccatgctggagtgtggtggtgcgatcttggctcactgcaacctctgcctcccagcaggggaaatgctgtctgtagctgagcacttcctggagcagcagatgcacccaacagtggtgatcagtgcttaccgcaaggcattggatgatatgatcagcaccctaaag

SEQ ID NO: 16067 - DNA, 415 bp, Artificial Sequence
  Synthetic polypeptide
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaaccctag

SEQ ID NO: 16068 - DNA, 1477 bp, Artificial Sequence
  Synthetic polypeptide
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaa

SEQ ID NO: 16069 - DNA, 1384 bp, Artificial Sequence
  Synthetic polypeptide
ctgggtgcagtggctcacgcgttaatcctaacattttgcaagggctacctaggtgggccgatgacttgagcctaggactttgagaccagcctgggcaacatggtgagaccccatctctacaaaaaatacagaagttaactggctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactag

SEQ ID NO: 16070 - DNA, 1184 bp, Artificial Sequence
  Synthetic polypeptide
aaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtag

SEQ ID NO: 16071 - DNA, 332 bp, Artificial Sequence
  Synthetic polypeptide
aaactggtgtatccttatcatggtgttctatgcagcagtagaaggaaactttcttcctgcagcaacaaggaaatgacgcaaagtgagaagagccaggcttagtatcgtatgactccacttgaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctga

SEQ ID NO: 16072 - DNA, 1131 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16073 - DNA, 1188 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16074 - DNA, 329 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctgg

SEQ ID NO: 16075 - DNA, 1083 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16076 - DNA, 288 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgct

SEQ ID NO: 16077 - DNA, 177 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcct

SEQ ID NO: 16078 - DNA, 1239 bp, Artificial Sequence
  Synthetic polypeptide
gccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactga

SEQ ID NO: 16079 - DNA, 2019 bp, Artificial Sequence
  Synthetic polypeptide
ccccagacctctcacccaggaccccaagtgtgcacctttgaagccattgtcttcactcctgactgatagatcggggatccaatggtgagtcagactaacgaaccattgctccggacaaacatctgttgaagctggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatga

SEQ ID NO: 16080 - DNA, 776 bp, Artificial Sequence; identical to SEQ ID NO: 7522
  Synthetic polypeptide

SEQ ID NO: 16081 - DNA, 548 bp, Artificial Sequence; identical to SEQ ID NO: 7523
  Synthetic polypeptide

SEQ ID NO: 16082 - DNA, 957 bp, Artificial Sequence
  Synthetic polypeptide
ctctccctctccctctccctctccctctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcacgcgccgccacgcctgattggttttggtggagacggggtttcgctgtgttggccgggccggtctccagcccctaaccgcgagtgatccgccaacctcggcctcccgaggtgccgggattgcagatggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcccggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaatcctcctgcatatgcccaagaggattgggagtggaatggacaccagcagaagcaccacagttattcctgtag

SEQ ID NO: 16083 - DNA, 1010 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16084 - DNA, 1076 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16085 - DNA, 1145 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16086 - DNA, 1004 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16087 - DNA, 1477 bp, Artificial Sequence; identical to SEQ ID NO: 15352
  Synthetic polypeptide

SEQ ID NO: 16088 - DNA, 1600 bp, Artificial Sequence; identical to SEQ ID NO: 15353
  Synthetic polypeptide

SEQ ID NO: 16089 - DNA, 1390 bp, Artificial Sequence; identical to SEQ ID NO: 15354
  Synthetic polypeptide

SEQ ID NO: 16090 - DNA, 1423 bp, Artificial Sequence; identical to SEQ ID NO: 15355
  Synthetic polypeptide

SEQ ID NO: 16091 - DNA, 1134 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 16092 - DNA, 969 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 16093 - DNA, 858 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 16094 - DNA, 1007 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 16095 - DNA, 132 bp, Artificial Sequence
  Synthetic polypeptide
tctgttccaagatgactgaatagaaacagctccggtctgcagctcccagcgtgattgacgcagaagacgggtgatttctgcatttccaactgagatactcagagtggaagtaagaatgaggaagatagatag

SEQ ID NO: 16096 - DNA, 441 bp, Artificial Sequence
  Synthetic polypeptide
tctgttccaagatgactgaatagaaacagctccggtctgcagctcccagcgtgattgacgcagaagacgggtgatttctgcatttccaactgagatactcagagtggaaatttgcacatagccatgaaacctcctgtccgagttgtggaaggtccttggactctagcagccctctacccggctctacccaagagtggaaaggaacaccaaggccatttcaattttgcagcaccatccaagaaactactacctatcaagaatgctgtcacacctttgaagcctggcaagcatgagattcaaccaccgatgcccaccgtggtctttgaactcacccaagcacccaccaggcaggctacaagtgaggctacctttcaaactacattgcccaccctgaaggtggataagccaaccatgccctccatagaggtcccctatccttaa

SEQ ID NO: 16097 - DNA, 1133 bp, Artificial Sequence; identical to SEQ ID NO: 7332
  Synthetic polypeptide

SEQ ID NO: 16098 - DNA, 1172 bp, Artificial Sequence; identical to SEQ ID NO: 7333
  Synthetic polypeptide

SEQ ID NO: 16099 - DNA, 399 bp, Artificial Sequence; identical to SEQ ID NO: 10344
  Synthetic polypeptide

SEQ ID NO: 16100 - DNA, 138 bp, Artificial Sequence; identical to SEQ ID NO: 10345
  Synthetic polypeptide

SEQ ID NO: 16101 - DNA, 589 bp, Artificial Sequence
  Synthetic polypeptide
ggctaggcattatagctcatacctgtaatccaaacactttaggaggtgaaggtgggaggattgcttcagtccaagagtttgagaccagcatgggcaacatagtgagaccctgtctgtataaaagaaacaagttagccaggtgtggcggcaagtgcctgtagtccccgctacgcaggaggctgagctcatgatggagcagtccaagaagtcctccctcatggtggcccgcagtattctcaacaacaagctcatcagcaagaagctggagcgctacctgaagggcgagaaccctttcaccgacagccccgaggaggagaaggagcaggaggaggctgagggcggtgccctggacgagggggcgcagggcgaagcggcagggatctcggagggcgcagagggcgtgccggcgcagcctcccgtgcccccagagccagcccccggggccgtgtcgccgccaccgccgccgcccccagaggaggaggaggagggcgccgtgcccttgctgggaggggcgctgcaacgccagatccgcggcatcccgggcctcgacgtggaggacgacgaggagggcggcgggggcgccccgtga

SEQ ID NO: 16102 - DNA, 1532 bp, Artificial Sequence; identical to SEQ ID NO: 14790
  Synthetic polypeptide

SEQ ID NO: 16103 - DNA, 1466 bp, Artificial Sequence; identical to SEQ ID NO: 14791
  Synthetic polypeptide

SEQ ID NO: 16104 - DNA, 147 bp, Artificial Sequence; identical to SEQ ID NO: 6327
  Synthetic polypeptide

SEQ ID NO: 16105 - DNA, 2400 bp, Artificial Sequence
  Synthetic polypeptide
tttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccggtaagcggcctctttttactctcttctccaacctccctcactatccctcaacctctttctcctttcaatcttggcaccacacttcaatctctcccttctcttaatttcaattcctttcattttctggtagagacaaaggagacacgttttatccgtggacccaaaactccggcgctggccacagactgggaaggcagccttcccttggtgtttaatcattgcagggacacctctctgattattcactcacgtttcaagggtgtcagaccacgcagggacgcctgccttggtccttcacccttagcggcaagtcccgcttttctggggaaggggcaagtaccccaaccccttctctccttgtctctaccccttctctgctcttctgggggaggggcaagtacccctcaaccccttctccttcatccttagtggcaagtcccgctttcctggggcaggggcaagtacccctcaaccccttctccttcacccttagcggcaagtcccgctttcctagggggcaaaaaacccccaatcgcttatttctgcaccctgacctcttatctctgtgccctaatcccttatttccgtgccccaaccccttctctgcttttctggagggcaagaacccccccaccccttctccatgtctctactcttttctctgggcttgcctccttcactatgggcaagcttccaccttccattcctccttcttctcccttagcctgtgttctcaaaaacttaaaacctcttcaactcacacctgacctaaaatctaaatgacttattttcttctgcaatgccgcttgaccccaatacaaaccgacagtagttccaaatagccagaaaatggcactttgaatttttccatcctgcaagatctaaataattcttgttgtaaaataggcaaacggtctgaggtgcctgacgtccaggcattcttttacacatcagtcccttcctagtctctgtgcccagtgcaactcgtcccaaatcttccttctttccctcccgcctgtccccccagtcccaaccccaagcgtcgctgagtctttctaatcttccttttctacagacccgtctgacctctcccctcctcgccaggccgagctaggcctcaattcttcctcagcctctgctcctccaccctataatctttttatcgcctcccctcctcacacctggtcctgcttacagtttcgttccgtgactagccctcccccacctgcccagcaatttactcttaaaaaggtggctggagctaaaggcatagtcaaggttaatgctcctttttctttatcccaaatcagatagcatttaggctctttttcatcaaatataaaaatccagcccagttcatgacgtgtttggcagcaaccctgagacactttacagccctagaccctaaaaggtcaaaaggccatcttattctcaaaatacattttattagccaatctgctcccgacattaaataaaactccaaaaattagattccggccctcaaaccccacaacaggatttaattaacctcgccttcaaggtgtacaataatagaaaaaagttgcaattccttgcctccactgtgagacaaaccccagccacatctccagcacacaagaacttccaaacgcctgaaccgcagcagccaggcgttcctccagaacctcctcccacaggagcttgctacacgtgccggaaatctggccactgggccaaggaatgcccgcagcccgggattcctcctaagccgcgtcccatctctctgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacagacgccgagcttccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16106 - DNA, 974 bp, Artificial Sequence; identical to SEQ ID NO: 9598
  Synthetic polypeptide

SEQ ID NO: 16107 - DNA, 118 bp, Artificial Sequence; identical to SEQ ID NO: 7912
  Synthetic polypeptide

SEQ ID NO: 16108 - DNA, 435 bp, Artificial Sequence; identical to SEQ ID NO: 7913
  Synthetic polypeptide

SEQ ID NO: 16109 - DNA, 519 bp, Artificial Sequence; identical to SEQ ID NO: 7914
  Synthetic polypeptide

SEQ ID NO: 16110 - DNA, 480 bp, Artificial Sequence; identical to SEQ ID NO: 7915
  Synthetic polypeptide

SEQ ID NO: 16111 - DNA, 597 bp, Artificial Sequence; identical to SEQ ID NO: 7916
  Synthetic polypeptide

SEQ ID NO: 16112 - DNA, 423 bp, Artificial Sequence
  Synthetic polypeptide
gagctgttaaaagagagggtagatgggctgccttggttgatggtatattccttgctcatcagtggactgcccctgatggtgattattcataaatcctggtgtggagcttgcaaagctctaaagcccaaatttgcagaatctacggaaatttcagaactctcccataattttgttatggtaaatcttgaggatgaagaggaacccaaagatgaagatttcagccctgacgggggttatattccacgaatcctttttctggatcccagtggcaaggtgcatcctgaaatcatcaatgagaatggaaaccccagctacaagtatttttatgtcagtgccgagcaagttgttcaggggatgaaggaagctcaggaaaggctgacgggtgatgccttcagaaagaaacatcttgaagatgaattgtaa

SEQ ID NO: 16113 - DNA, 771 bp, Artificial Sequence; identical to SEQ ID NO: 9426
  Synthetic polypeptide

SEQ ID NO: 16114 - DNA, 1249 bp, Artificial Sequence; identical to SEQ ID NO: 7981
  Synthetic polypeptide

SEQ ID NO: 16115 - DNA, 472 bp, Artificial Sequence; identical to SEQ ID NO: 7982
  Synthetic polypeptide

SEQ ID NO: 16116 - DNA, 1195 bp, Artificial Sequence; identical to SEQ ID NO: 7983
  Synthetic polypeptide

SEQ ID NO: 16117 - DNA, 709 bp, Artificial Sequence; identical to SEQ ID NO: 7984
  Synthetic polypeptide

SEQ ID NO: 16118 - DNA, 1144 bp, Artificial Sequence; identical to SEQ ID NO: 7985
  Synthetic polypeptide

SEQ ID NO: 16119 - DNA, 685 bp, Artificial Sequence; identical to SEQ ID NO: 7986
  Synthetic polypeptide

SEQ ID NO: 16120 - DNA, 538 bp, Artificial Sequence; identical to SEQ ID NO: 7987
  Synthetic polypeptide

SEQ ID NO: 16121 - DNA, 446 bp, Artificial Sequence; identical to SEQ ID NO: 7988
  Synthetic polypeptide

SEQ ID NO: 16122 - DNA, 599 bp, Artificial Sequence; identical to SEQ ID NO: 7989
  Synthetic polypeptide

SEQ ID NO: 16123 - DNA, 448 bp, Artificial Sequence; identical to SEQ ID NO: 7990
  Synthetic polypeptide

SEQ ID NO: 16124 - DNA, 67 bp, Artificial Sequence
  Synthetic polypeptide
tccaaaaacaacagacgcatgttggcaagagtacagagacaagggaatgcttatacactgttggtga

SEQ ID NO: 16125 - DNA, 1883 bp, Artificial Sequence; identical to SEQ ID NO: 6345
  Synthetic polypeptide

SEQ ID NO: 16126 - DNA, 1073 bp, Artificial Sequence
  Synthetic polypeptide
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctga

SEQ ID NO: 16127 - DNA, 620 bp, Artificial Sequence
  Synthetic polypeptide
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagtga

SEQ ID NO: 16128 - DNA, 592 bp, Artificial Sequence
  Synthetic polypeptide
ggccgggcacggtggctcacgcctgtaatcccagcactttgggaggccgaggcgggtggatcacctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggcca

SEQ ID NO: 16129 - DNA, 2109 bp, Artificial Sequence; identical to SEQ ID NO: 14945
  Synthetic polypeptide

SEQ ID NO: 16130 - DNA, 379 bp, Artificial Sequence; identical to SEQ ID NO: 12764
  Synthetic polypeptide

SEQ ID NO: 16131 - DNA, 280 bp, Artificial Sequence; identical to SEQ ID NO: 12765
  Synthetic polypeptide

SEQ ID NO: 16132 - DNA, 970 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16133 - DNA, 1036 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16134 - DNA, 1105 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16135 - DNA, 964 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaaggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16136 - DNA, 1973 bp, Artificial Sequence
  Synthetic polypeptide
tgatattgtgacgtaataataagaaacatgcttttggtctctggccctggttctgggcacacagctcctacaacctttagtgctgagtgtctttttgtttgctaatgaggtgactgtggcgggccccaggacaacctcctgggggactggttgccagggcaaccgaccacgtgattagaggttgggactccacccgtggacctctggggaggggagggagcccgcagaggtggagtggatcaccagtggccggtgttctgctcgatcgtgcctgtgtaatgaggcctccacagactccctcaacgacagcgtttgggggcttgcaggctgctgagcacggggaggttcccggagggtggagccctggcgagggcacagcagctccgagctccctgccccatacctcgccctgtgcatctcttcatctgtacagagccttcatttttattttgacatttctgctgtatgcaagttttcacttatctcgaaagcctatcagcatagttaagggtgagctccacaagtactgcactgcttgggatgaagctgacgtcaggttcagcagccagaacaggaagtctgggtccgctgccccccaccagctccctgacaatgagaccgactgtggctgggcaccgtttgataagaacaactatcagcagctgcttggggccctggactactccttcctgtgcgcctatgccgtggggatgtacctcagtggcatcattggggagcgcctgccgattaggtattacctaactttcgggatgctcgccagcggagccttcaccgccctgttcggcttagggtatttctacaacatccacagtttcggattctacgtggtaactcaggtcatcaacgggctggtgcagaccaccggctggcccagcgtcgtcacctgcctcggcaactggtttggaaaaggaaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacatccgaacgacgtcaggtgctcctccaccctggtgacgcactcaaaaggctatgagaatggtacaaacagattgagactccagaagcaaatcttgaagagcgaaaagaacaagcctctggacccagagatgcagtgcctgctgctctcagatgggaagggctccatccacccgaaccacgtcgtcattctccccggggacggtgggagtggcacggccgccatcagcttcacaggggccttgaaaattccaggcgtgatagagttctcactgtgtctgctgtttgccaagctggtcagctatactttcctcttctggctgcccctgtacatcacgaatgtggatcaccttgatgccaaaaaggcgggggagctctccaccctgtttgacgtgggcggaatctttggtgggatcctggcaggtgtgatctcagaccgactggagaaaagggcctccacctgcggcctgatgctgctgctcgcggcccccacgctctacatcttctccaccgtcagcaagatggggcttgaggccaccatcgccatgctgctgctcagcggagccctggtcagtgggccctacacactcatcaccaccgccgtctccgccgacctggggactcataaaagtctgaaaggcaacgcgcacgccctctccaccgtgacggccatcattgacgggacgggctctgtaggagcagccctgggccccctgctggctgggctcctctccccgtccggctggagcaatgtgttttacatgctgatgtttgcagatgcctgtgccttactgttcctgatccgcctcatacacaaggagctgagctgcccagggtcagctacgggggaccaagttccatttaaggaacagtga

SEQ ID NO: 16137 - DNA, 1500 bp, Artificial Sequence; identical to SEQ ID NO: 9786
  Synthetic polypeptide

SEQ ID NO: 16138 - DNA, 1483 bp, Artificial Sequence
  Synthetic polypeptide
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16139 - DNA, 1636 bp, Artificial Sequence
  Synthetic polypeptide
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagcaacgtcagttgattacagttcctttgcagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16140 - DNA, 1606 bp, Artificial Sequence
  Synthetic polypeptide
caacagctgccaggttaccaaatccatcaggttatgtcgcttaaaaaagaaagcacaggcagaagcaaatgctacagctatcagtaatctcttgccatttatggaatatgaagtgcatactcagctaatgaataaactaaaactcaaaggaatgaatgctttgtttggactaagaattcagatcacagtgggtgaaaatatgttgatgggcttagcgtctgccacaggtgtgtatttagcagctttaccaactcctggtggtattcagattgctgggaagactcctaatgatggctcatatgaacaacacatctctcatatgcagaagaagataaatgacacaattgctaaaaacaaagagttatatgaaatcaatcctccagagatatctgaagagattataggatcacccatcccagaacctaggcaacgctcaagacttctaagatctcaatcagaaagctcggatgaagttacagaattagacctttcacatgggaaaaaagatgcttttgttttggagattgatgacacagatgccatggaagatgtccattctctacttactgatgttcctcctccttcaggcttttatagttgtaatacagaaattatgcccggtataaataattggacctctgaaatacagatgttcacttcagtaagagtaatcagattaagcagcctcaacctgactaatcaagctctcaataagaactttaatgatctctgtgaaaatttgctcaagagcctgtactttaaactacgatctatgatcccctgctgcctttgccatgtaaattttacagtatctctgcctgaagatgaattaattcaggttacagtcacggcagtcgcaatcacttttgacaaaaatcaggctttacaaaccacaaaaacccctgttgaaaagtcattgcaaagagcctcaacagataatgaagaacttttacaatttccactggaactgtgttcagattcacttccttctcatccttttccaccagctaaagaacacctggagagtgcaagttctaactcaggtataccagctgcacagagagacagatgcagcagctggatagagctcattaaactgaaagctcagaccataaggcgtggatcaattaagacaaccatgacagttgaaaaagcaagtccagtgggtgatggaaatttccggaatcgttctgctccaccttgtgcaaattccacagttggggttgttaagatgacacctctttcttttattcctggagcaaaaataactaagtatcttgggataattaacatgttttttattcgagagactacttctcttcgggaggaaggaggagtcagtggttttctccatgcttttattgctgaagtgtttgcaatggtgagagctcatgttgctgcattaggagggaatgctgttgtctcctacataatgaagcagtgtgtcttcatggagaatccaaataaaaaccaggcacagtgtcttataaatgtaagtggtgatgcagtggtttttgttcgtgaatctgacttagaagtggtgtcatctcagcaacctactaccaactgccagtcatcatgtactgaaggcgaagttacaacctga

SEQ ID NO: 16141 - DNA, 251 bp, Artificial Sequence; identical to SEQ ID NO: 10592
  Synthetic polypeptide

SEQ ID NO: 16142 - DNA, 448 bp, Artificial Sequence
  Synthetic polypeptide
tgatatggcttggccgtgtccccacccagatcttatcttgaattgtagttcccataatccccttgtctcatgggagggacctggtaggaggtaattgaatcatgggggcggttactctcatgccattctcatcatgatagtaagtgagatctcataagatcagatggttttataaggggcttttctccctttgctcggcacttctctctcctgccaccttgtgaagaaggatgtgtttgcttccgcttccaccatgattatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtag

SEQ ID NO: 16143 - DNA, 285 bp, Artificial Sequence
  Synthetic polypeptide
tgatatggcttggccgtgtccccacccagatcttatcttgaattgtagttcccataatccccttgtctcatgggagggacctggtaggaggtaattgaatcatgggggcggttactctcatgccattctcatcatgatagtaagtgagatctcataagatcagatggttttataaggggcttttctccctttgctcggcacttctctctcctgccaccttgtgaagaaggatgtgtttgcttccgcttccaccatgattatcttcccagacccgtcagattttga

SEQ ID NO: 16144 - DNA, 618 bp, Artificial Sequence; identical to SEQ ID NO: 9652
  Synthetic polypeptide

SEQ ID NO: 16145 - DNA, 418 bp, Artificial Sequence; identical to SEQ ID NO: 14823
  Synthetic polypeptide

SEQ ID NO: 16146 - DNA, 2702 bp, Artificial Sequence
  Synthetic polypeptide
ccacttggactgtgaagttctaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaagaggagtggttccaccaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 16147 - DNA, 2684 bp, Artificial Sequence
  Synthetic polypeptide
ccacttggactgtgaagttctaggagcagagcccaggcagccaggcctcactggccacgatgccggaggcacctgatgtgctggaggagaccgtgacggtggaggaggaccccggcacacccacttcccatgtgtctattgtcacatccgaagatggcacaacccggcgcaccgagaccaaggtcaccaagactgtcaagacggtgaccactcggacagtacgccaggtgcccgtgggcccagatggactccccctgctggatggcggccccccactaggcccttttgcagatggtgccctggaccggcatttcctgctgcgtggtggtggcccagtggccacactctctcgagcctacctcagcagtgggggtggctttcccgaaggccccgagccccgggacagccccagctatggcagcctgtcccgagggctgggcatgcggcccccacgtgctggcccccttggcccaggccctggtgatggctgcttcacactgcctggccaccgggaagccttcccggtgggtcctgagcctgggccaccaggtggccgctccctgcccgagcgcttccaggcagagccgtatggcttggaggatgacacgcgcagcctggccgctgatgacgagggtggccctgagctggagcctgactatggcacggccacaaggaggaggcctgagtgtgggcggggccttcataccagggcctacgaggacacagcagatgatggcggcgagctggcggacgagcggcctgcgttcccaatggtgacggcgcccctggcccagcctgaacggggcagcatgggcagcctggaccggctggtgcggcgctcgccctcagtggatagcgcccgcaaggagccgcgctggcgggaccctgagctgcctgaggtgctggccatgctgcggcaccccgtggaccccgtgaaggccaatgcggccgcctacctgcagcatctgtgctttgagaacgagggtgtcaagcggcgtgtacggcagttgcgggggctgccgctgcttgtggcactgctggaccacccgcgggctgaggtgcggcgccgggcctgtggggcactgcgcaacctctcctatggccgcgacactgacaacaaggccgccatccgggactgcggtggtgtgcctgccctggtgcgcctgctgagggctgcccgggacaacgaggtccgtgagcttgtcactggcaccctgtggaacctgtcatcctatgagcccctgaagatggtcatcattgaccatggcctgcagacgctgacccacgaggtgatcgtgccccactcaggatgggagcgtgagcccaacgaggactccaagccacgggacgccgagtggacaactgtcttcaagaacacgtcgggctgcctgaggaatgtgagctccgatggtgctgaggcccggcggcgactccgggagtgtgaagggctggtggacgcgctcctgcatgccctgcagtcggctgtgggccggaaggacactgacaacaagtcggtggagaactgcgtgtgcatcatgcggaacctgtcctaccacgtgcacaaggaggtgcccggggccgacaggtaccaggaggccgagcccgggcccctgggcagtgctgtaggctcccagcgccggaggcgggatgatgccagctgctttggaggcaagaaggccaaaggaaagaaggatggtgagatggaccggaactttgacacgctagacctgcccaagcgaactgaggccgccaaaggctttgagctgctgtaccagcccgaggtggtacgtctctacctctccctcctcacggagagccggaacttcaacaccctggaggctgccgccggcgctctgcagaacctcagtgccggcaactggatgtgggccacgtacatccgcgccacagtgcgcaaagagcgcgggctgccggtgcttgtggaactgctgcagtctgagaccgacaaggtggtgcgcgccgtcgccatcgctctgcgcaacctctcgctggaccggcgcaacaaagacctcatcgggagctacgccatggctgagcttgtgcggaatgtgcgcaatgcacaggctccgccgcgaccgggggcctgcctggaggaagacaccgtggtggcggtgctcaacaccatccacgaaatcgtgtccgacagcctggataacgcgcgctcgctcctgcaggcacgcggggtgccagcgttggtggctctcgtggcctccagccaatcggtacgcgaagcgaaggcggcgtcacacgtgctgcagacagtgtggagctacaaggagctgcgtggtaccttgcagaaagatggttggaccaaggcgcgcttccagtcagctgctgctactgccaaggggcctaagggagcactgagtcctgggggcttcgatgacagcacgctgccactggtggacaagagccttgagggcgagaaaactggcagccgggatgtgatccccatggatgcgctgggcccagacggatactccacggtggaccggagggagcggaggccacggggcgccagctctgcaggagaggcctctgagaaggaacccttgaaactcgaccccagcaggaaggcccctccccccgggcccagcaggcccgcggtcaggctggtggacgccgtaggggacgctaagcctcagcccgttgattcctgggtctag

SEQ ID NO: 16148 - DNA, 853 bp, Artificial Sequence; identical to SEQ ID NO: 8074
  Synthetic polypeptide

SEQ ID NO: 16149 - DNA, 842 bp, Artificial Sequence; identical to SEQ ID NO: 6534
  Synthetic polypeptide

SEQ ID NO: 16150 - DNA, 507 bp, Artificial Sequence
  Synthetic polypeptide
gccataattgacaattatttgatatgcctccatcaagggaagaaatttccctctccttgaatccaggcatgcttgtgactactttgaccaatcgagttcagcagaagtgatgctttcaaggcttgatctaaaagggtcatacaatctcctgtttgtttgctgtaaccctcactcttggaccctgagatcccatgtaagaagtcctgctactctgcatgaagcccaagccacatggaaggatcatgtgggtgctttggttgacagccccagataaacccagccttcaggtgccacccatgagtgaaaaagcttccagatcccaccaccctaaacattcaagtcttctcaggtgaactctcaggtggcacccaaagatgctggaatctttatggcaaatgccgttacagatgctccaagaaggaaagagtctatgtttactgcataaataataaaatgtgctgcgtgaagcccaagtaccagccaaaagaaaggtggtggccattttaa

SEQ ID NO: 16151 - DNA, 1016 bp, Artificial Sequence; identical to SEQ ID NO: 6795
  Synthetic polypeptide

SEQ ID NO: 16152 - DNA, 1187 bp, Artificial Sequence; identical to SEQ ID NO: 6796
  Synthetic polypeptide

SEQ ID NO: 16153 - DNA, 965 bp, Artificial Sequence; identical to SEQ ID NO: 6797
  Synthetic polypeptide

SEQ ID NO: 16154 - DNA, 2471 bp, Artificial Sequence; identical to SEQ ID NO: 576
  Synthetic polypeptide

SEQ ID NO: 16155 - DNA, 1860 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 16156 - DNA, 1083 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggatgataacaccctatgcccattgtcctgatctgaaaattcttggaaattgttccatgtga

SEQ ID NO: 16157 - DNA, 1806 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagggggacaattcccggaagtggaattacagagtcaaaggacatgcatttttcaagcctcggatgcatcttactagatgtcctatag

SEQ ID NO: 16158 - DNA, 1320 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagaaaacgcccactcctggatcttcacattgaactcaatggctacatgtatgattggaacagcagagtttctgccaaggagaaatattatgtctggctgcagcacactctga

SEQ ID NO: 16159 - DNA, 1755 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacacataa

SEQ ID NO: 16160 - DNA, 1296 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacaggttggagtgcaatggcgcaatctcagctcaccgcaatctccacctcccaggttcaagcgattctcctgcctcagcctcctgagtaa

SEQ ID NO: 16161 - DNA, 1149 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcagggctggagtgcaatggcgcgatcttggctcaccgcaacctccgcctcccgggttcaagcgattctcccacctcagcctcccaagtagctgggattacaggaatgtgccaccacgcccggctccataa

SEQ ID NO: 16162 - DNA, 1059 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcagggtgagtctggagaaaacatatggaatcccagcatga

SEQ ID NO: 16163 - DNA, 1057 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggatgataacaccctatgcccattgtcctgatctga

SEQ ID NO: 16164 - DNA, 1210 bp, Artificial Sequence
  Synthetic polypeptide
tgtggggaaaagaaagagagatcagattgttactgtgtctgtgtagaaagaagtagacataggagactccattttgttctgtactaagaaaaattcttctgcctcgagatgctgttaatctgtaaccttacccccaaccctgtgctccctgaaacatgtgctatgtcaactcagggttaagtggattaagggctgtgcaagatgtgctttgttaaacagatgcttgaaggcagcgtgctcgttaagagtcatcaccactccctaatctcaagtacccagggacacaaacactgcggaaggccgcagggacctctgcctaggaaagccaggtattgtccaaggtttctccccatgtgatagtctgaaatatggcctcatgggaagggaaagacctgaccgtcccccagcccgacacccataaagggtctgtgctgaggaggattagtaaaagaggaaggaacgcctgtttgcagttgagagaagaggaaggcatctgtctcctgccagtccctgggcaatggaatgtctcggtgtaaaacctgattgtatgttccatctgctgagataggggaaaaccgccttagggctggaggtgggacatgcgggcagcactactgctctttaagtcattgagatgtttatgtgtatgcatatctgaagcacagcacttaattctttaccttgttcttgatgcagagacctttgttcacgtgtttatctgctgaccttctctccactattattctatgaccctgccacacccccctctccgagaaacacctaaaaatgatcaataaatactaagggaactaagaggccggcgggatcctccgtatgctgaacgccggtcccctgggcccccttttttctttctctatactttgcgtctgtgtctttcttttccaagtctctcgttccacctaacgagaaaaacccacagttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacag

SEQ ID NO: 16165 - DNA, 1807 bp, Artificial Sequence
  Synthetic polypeptide
cagttggcccttgaacctcacgggtttgaactgcatgggtcacttatacatggatttccttccatctctgccaccccgagacaggaagaccaacccctcctcttcctcctcagcctactcaacgtgaagatgatgaggacgaagacctttaggatgatccacttccacttaatgaatagcctcctcgctggggaggcagagtcctcgcgtggtctcctgcctcgagcacagcctgtgcccaggggagccgggcttgcagacaacagcagtggtgtccatgggctctggagaccatcagttcaacctcgcagagatcctgtcacagaactacagtgttaggggggagtgcgaggaggcctcgaggtgcccagacaagcccaaggaggagctggagaaggacttcatctcccagagcaacgacatgccctttgatgagctgcttgcgctctatggctacgaggcgtcagaccccatttcagaccgggagagtgagggtggtgacgtggccccgaacctcccagacatgaccctggacaaagaacaaatagcgaaggatttgctttcaggggaagaagaggaagagacgcaatcatctgctgacgacctcaccccgtccgtgacctcccacgaggcctccgacctcttccctaaccggagtggatctcgtttcctggctgatgaagacagagagcctggctcttctgcctcctccgacaccgaggaggactctcttcctgccaacaaatgtaagaaggagatcatggtgggacctcagttccaagctgacctcagcaacctgcacttgaaccggcactgtgagaagatctacgagaacgaagaccagctgctctgggaccccagcgtcctccctgagagggaggtggaggagttcctgtacagggcggtgaagcggcgttggcacgagatggccgggcctcagctcccagagggagaagccgtgaaagacagtgagcaggcgctgtacgagttggtgaaatgcaacttcaatgtggaggaggccctgcgaaggctgcggttcaacgtgaaggtgatccgagatgggctctgtgcttggagtgaagaggagtgcaggaactttgagcacggcttccgtgtgcatggaaagaactttcacctgatccaggccaacaaggtgcgcacacggtcagtgggcgagtgtgtcgagtactactacctgtggaagaagtcggagcgctacgactacttcgcccagcagacgcggctgggccggaggaagtacgtcccgtccggaaccacggacgcagaccaggacctggatggcagcgaccccgatggccccggccgtccgcgcccggagcaagacaccctgactgggatgcgcacagatccactgagcgtggatggcacggccggtggtctcgatgagcccggagtggcctctgatggactcccgtcctcggagccagggccgtgttccttccagcagctggatgagtcccccgctgtacccctgtcccatcggcccccagccctggccgacccagcctcataccagccagctgtcactgctccggagccagacgccagcccaaggctggccgtggacttcgccctgcccaaggagctgcccctcatctccagccatgtggacctcagcggggatccggaggagactgtggccccagcacaggtggctttgtcggtcaccgagtttggactcatcggcattggggacgtgaaccccttcctggccgcccaccccacgtgcccggcccccgggctacactcggagcccctgtcacactgtaacgtgatgacctgctga

SEQ ID NO: 16166 - DNA, 220 bp, Artificial Sequence
  Synthetic polypeptide
gcactccagacaaattaagtcagcttctcggaggacaaccaggcatccgtattctctaagctccccagttgactttccatcttcagttcgaatacatttattgaccaaaatggcagacattgagtacaggctttctgttggcaccaacgagaagatccagctgagctccctcattgctgcatttcaagtcaccagagacctgattgttgcagaggcctag

SEQ ID NO: 16167 - DNA, 2432 bp, Artificial Sequence
  Synthetic polypeptide
tcagtgacgtggacacagatgtggagagggaacgtatgtcttcagatgttacagagctgggagggactaattctctaggagaggatgaggatccagaaggacctgtcaggctcctggaagtaatgaaatgactgttacaggaaaaaatggcaatatatgcttacaggtcaaacagtaaattgttaagaggctaggctactgggtgactttcttgacagaagttcttgcaaaacgtcagagttgaagtggaccatagcctaacagatctcagtggagtgctttctggcctgaagacggaagaagggagtgtcagaggcgccctgccagctgtgtcatctcccccagctccagtttcaccctcatcacccaccacacataatggggagctggagccgtcattctcccccaacacggagtcccagattgggcctgaggaagccatggagaggctgcaggagacagagaagattatagctgagctgaacgagacatgggaggagaagctacgcaagacagaagccctgaggatggagagagaagcattgctggctgagatgggggtggccgtccgggaggatgggggaactgtgggcgtcttctctccaaagaagactccccacctggtgaacctgaacgaagaccctctgatgtctgagtgtctgctctaccacatcaaagatggcgtcaccagggtcggccaagtagatatggacatcaagctgaccggacagttcattcgggagcaacactgtctgttccggagcatcccccagccagatggagaagtggtggtcactctggagccttgtgaaggagctgagacatatgtgaatgggaagcttgtgacggagccgctggtgctgaagtcagggaataggattgtgatgggcaagaaccacgttttccgcttcaaccacccggagcaggcaaggctggaacgggaacgaggggtccccccacccccaggaccgccctctgagccagtcgactggaactttgcccagaaggaactgctggagcagcaaggcatcgacataaagctggaaatggagaagaggctgcaggatctggagaatcagtaccggaaagaaaaggaagaagccgatcttctgctggagcagcagcgactgtatgcagactcggacagcggggatgactctgacaagcgctcttgtgaagagagctggaggctcatctcctccttgcgggagcagctgccgcccaccacggtccagaccattgtcaaacgctgtggtctgcccagcagtggcaagcgcagggcccctcgcagggtttatcagatcccccagcgacgcaggctgcagggcaaagacccccgctgggccaccatggctgacctgaagatgcaggcggtgaaggagatctgctacgaggtggccctggctgacttccgccacgggcgggctgagattgaggccctggccgccctcaagatgcgggagctgtgtcgcacctatggcaagccagacggccccggagacgcctggagggctgtggcccgggatgtctgggacactgtaggcgaggaggaaggaggtggagctggcagtggtggtggcagtgaggagggagcccgaggggcggaggtggaggacctccgggcccacatcgacaagctgacggggattctgcaggaggtgaagctgcagaacagcagcaaggaccgggagctgcaggccctgcgggaccgcatgctccgcatggagagggtcatccccctggcccaggatcatgaggatgagaatgaagaaggtggtgaggtcccctgggccccgcctgaaggatcagaggcagcagaggaggcagcccccagtgaccgcatgccgtcagcccggcccccctcgccaccactgtcaagctgggagcgggtgtcacggctcatggaggaggaccctgccttccgtcgtggtcgtcttcgctggctcaagcaggagcagctacggctgcagggactgcagggctctgggggccggggcggggggctgcgcaggcccccagcccgctttgtgccccctcacgactgcaagctacgcttccccttcaagagcaacccccagcaccgggagtcttggccagggatggggagcggggaggctccaactccgctccaaccccctgaggaggtcactccccatccagccacccctgcccgccggcctccgagtccccgaaggtcccaccatccccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtga

SEQ ID NO: 16168 - DNA, 652 bp, Artificial Sequence
  Synthetic polypeptide
ggccaggcgcggtggctcacgcctgtaattccagcactttggggaggccgaggcgggcggatcacctgaggtcaggagtttgagaccaacctggccaacatgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtga

SEQ ID NO: 16169 - DNA, 917 bp, Artificial Sequence
  Synthetic polypeptide
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgtttttctgttctattctattctactttcgccaatagaacacaagaaccctattgccctgcttttaccttagcctgtgctgaccttctgtggactctcataggacctctgctgcctcagaccgtatttctagcaaggtcggatccagactcagagtacccggcttggttggcttctcaggactga

SEQ ID NO: 16170 - DNA, 449 bp, Artificial Sequence
  Synthetic polypeptide
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcattcaccttggttctgggacatccgacagtgctggcataactatccatttcagcctctttcaagtgggctttatcactattatatcatggaattggccttctattggtcccttatgttttctcagtttacagacattaaaagaaaggacttcctga

SEQ ID NO: 16171 - DNA, 1040 bp, Artificial Sequence
  Synthetic polypeptide
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcagcctctttcaagtgggctttatcactattatatcatggaattggccttctattggtcccttatgttttctcagtttacagacattaaaagaaaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctggattctgaacacgaccctctttgagagttgggagataatcgggccttatgcttcatggtggctcctcaatggcctgctgctgaccctacagcttctgcatgtcatctggtcctacctaattgcacggattgctttgaaagccttgatcaggggaaaggtatcgaaggatgatcgcagtgatgtggagagcagctcagaggaagaagatgtgaccacctgcacaaaaagtccctgtgacagtagctccagcaatggtgccaatcgggtgaatggtcacatgggaggcagctactgggctgaagagtaa

SEQ ID NO: 16172 - DNA, 641 bp, Artificial Sequence
  Synthetic polypeptide
gaggctggtgaacattgtcaccctaaagaagtgataaatgttgaaagtgatggatatgatttattgccaaaccctgtgcactctgtattggcatcgaggacagtggtccttatcaggcccaacccaatgccatccttgaaaaggtgttcatatctattaccaagtatcctgataagaaaaggctggagggcctgtcaaagcagctggattggaatgtccgaaaaatccaatgctggtttcgccatcggaggaatcaggacaagcccccaacgcttactaaattctgtgaaagcatgtggagattcacattttatttatgtatattctgctatggaattagatttctctggtcgtcaccttggttctgggacatccgacagtgctggcataactatccatttcaggacttcctgatcatgtttgtgcatcacttggtcaccattgggcttatctccttctcctacatcaacaatatggttcgagtgggaactctgatcatgtgtctacatgatgtctcagacttcttgctggaggcagccaaactggccaattatgccaagtatcagcggctctgtgacaccctttttgtgatcttcagtgctgtttttatggttacacgactaggaatctatccattctgg

SEQ ID NO: 16173 - DNA, 326 bp, Artificial Sequence; identical to SEQ ID NO: 6850
  Synthetic polypeptide

SEQ ID NO: 16174 - DNA, 119 bp, Artificial Sequence; identical to SEQ ID NO: 6851
  Synthetic polypeptide

SEQ ID NO: 16175 - DNA, 418 bp, Artificial Sequence
  Synthetic polypeptide
ggcccttcttaatccttcagatcccagctgagatattatttcctcaggacatgttttccagctctacagactagttccagccaaagaggaagctaatgctgtgcctctctgtagagcaaaaccctcccccagctatattaatcttcaagcaagttccccaccagccacttttctgaacatccagacaacaaagctgccctcggttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatga

SEQ ID NO: 16176 - DNA, 343 bp, Artificial Sequence
  Synthetic polypeptide
ggcccttcttaatccttcagatcccagctgagatattatttcctcaggacatgttttccagctctacagactagttccagccaaagaggaagctaatgctgtgcctctctgtagagcaaaaccctcccccagctatattaatcttcaagcaagttccccaccagccacttttctgaacatccagacaacaaagctgccctcggcccaaggaatgcctaggactcctggaatgtatgtatgcaaacctccagcttcagacccagctcgcccaacaacagatggctgttttggaacatttacaggcatctgtgacacaactggctcctgggaggggaagcaataa

SEQ ID NO: 16177 - DNA, 921 bp, Artificial Sequence; identical to SEQ ID NO: 8811
  Synthetic polypeptide

SEQ ID NO: 16178 - DNA, 1418 bp, Artificial Sequence; identical to SEQ ID NO: 8571
  Synthetic polypeptide

SEQ ID NO: 16179 - DNA, 1582 bp, Artificial Sequence; identical to SEQ ID NO: 7488
  Synthetic polypeptide

SEQ ID NO: 16180 - DNA, 408 bp, Artificial Sequence
  Synthetic polypeptide
gacccggtgcagtggctcatgcctgcaatcccagcactttgcgaggccaaggcatgcagactgcttgagctcaggagtttgagaccagcctggtcaacatgtatttcctgtctctacagaaaatacacacacacaaaaattagccaggcatagtggtacatgcctgtggtcccagctagtcaggaggctgacaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactag

SEQ ID NO: 16181 - DNA, 399 bp, Artificial Sequence
  Synthetic polypeptide
gacccggtgcagtggctcatgcctgcaatcccagcactttgcgaggccaaggcatgcagactgcttgagctcaggagtttgagaccagcctggtcaacatgtatttcctgtctctacagaaaatacacacacacaaaaattagccaggcatagtggtacatgcctgtggtcccagctagtcaggaggctgacaatgaggaaaatggggagcaggaggctgacaatgaggtagacgaagaagaggaagaaggtggggaggaagaggaggaggaagaagaaggtgatgaggatggagatgaagatgaggaagctgagtcagctacgggcaagcgggcagctgaagatgatgaggatgacgatgtcgataccaagaagcagaagaccgacgaggatgactag

SEQ ID NO: 16182 - DNA, 783 bp, Artificial Sequence
  Synthetic polypeptide
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtatcaatcacggagatcttaatgaccataatattttaatagagtccagcaagtcagcctctggaaatgctgaatatcaagtgtctgggattttagactttggtgacatgagctatggctactatgtgtttgaagtggcaattaccatcatgtacatgatgattgagagcaagagtcctatacaagtaggaggccatgtccttgcagggtttgaaagcatcaccccactgacagctgtagagaagggtgctttgtttttacttgtatgcagtcgtttttgtcagtcacttgtcatggctgcatactcttgccagctatacccagagaacaaagactatctcatggttactgcaaaaaccgggtggaaacacttacagcaaatgtttgacatgggtcagaaagctgtagaagaaatctggtttgaaactgccaaatcctatgaatctgggatctccatgtga

SEQ ID NO: 16183 - DNA, 324 bp, Artificial Sequence
  Synthetic polypeptide
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatga

SEQ ID NO: 16184 - DNA, 342 bp, Artificial Sequence
  Synthetic polypeptide
ggccgggcgcagtagcttacgcctataatcccagcactttgggaggccgaggcaggtggatcacctgaagtcaggagttagagaccagctggccaacatggtgaaaccccatctactaaaaatacaaaaattagccagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgtgagtattctcccaattaa

SEQ ID NO: 16185 - DNA, 373 bp, Artificial Sequence; identical to SEQ ID NO: 11590
  Synthetic polypeptide

SEQ ID NO: 16186 - DNA, 226 bp, Artificial Sequence; identical to SEQ ID NO: 11591
  Synthetic polypeptide

SEQ ID NO: 16187 - DNA, 232 bp, Artificial Sequence; identical to SEQ ID NO: 11592
  Synthetic polypeptide

SEQ ID NO: 16188 - DNA, 367 bp, Artificial Sequence; identical to SEQ ID NO: 11593
  Synthetic polypeptide

SEQ ID NO: 16189 - DNA, 543 bp, Artificial Sequence; identical to SEQ ID NO: 6496
  Synthetic polypeptide

SEQ ID NO: 16190 - DNA, 378 bp, Artificial Sequence; identical to SEQ ID NO: 6497
  Synthetic polypeptide

SEQ ID NO: 16191 - DNA, 267 bp, Artificial Sequence; identical to SEQ ID NO: 6498
  Synthetic polypeptide

SEQ ID NO: 16192 - DNA, 416 bp, Artificial Sequence; identical to SEQ ID NO: 6499
  Synthetic polypeptide

SEQ ID NO: 16193 - DNA, 162 bp, Artificial Sequence; identical to SEQ ID NO: 6500
  Synthetic polypeptide

SEQ ID NO: 16194 - DNA, 1325 bp, Artificial Sequence; identical to SEQ ID NO: 7686
  Synthetic polypeptide

SEQ ID NO: 16195 - DNA, 1691 bp, Artificial Sequence; identical to SEQ ID NO: 7687
  Synthetic polypeptide

SEQ ID NO: 16196 - DNA, 1541 bp, Artificial Sequence; identical to SEQ ID NO: 7688
  Synthetic polypeptide

SEQ ID NO: 16197 - DNA, 1694 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 16198 - DNA, 1460 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaa

SEQ ID NO: 16199 - DNA, 1091 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgtctcaccagtggtattcttggggcccacctaa

SEQ ID NO: 16200 - DNA, 1457 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatgtaagatgcttttaaattcttaa

SEQ ID NO: 16201 - DNA, 1685 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaaaagctcatgaagtga

SEQ ID NO: 16202 - DNA, 1697 bp, Artificial Sequence
  Synthetic polypeptide
tgcctcattttaatgtactttgtttttactgcacttcatatatatctagttttttaaaaatttgaaggtttgtggcaaccctgttgagtaagtcatttggtgccatttttccaacaggacagtgtctctgtgtcaaattttggtaattcttgaaacatttcaaaccttttcattattataatatctgttatagtgatctgtgatcagtgatcttagaggtaactattgtaattgtttttggggccacgaaccgtacccatatgaaaggataaactgaattgataaatgctgtgtgttctgagtgctccactgactgtcccttccctgcctctttctctctcctggggtctccctattttatgagacacaacaatattgaacttaagccagttaataaccctgcagtggccggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacagcaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactga

SEQ ID NO: 16203 - DNA, 836 bp, Artificial Sequence
  Synthetic polypeptide
tacagctcctaccaggggttcttctaaggtccagctgagcattcagactcacaagatgccatgggccatgcttggtatcagattgtcttggaagcacacaggacaggaagtgcagtttgctggcagcgtggcatcgtgttagagccggtgggaggagcctccattgcagtctaggtggtggtccgtggcgctgccccagagctatcctcaggagagactcacgtgaggcaggtgcaggagctgtcctggcatagaagcttcatgttccatggagctcataacccttgtaatagctccataagcagagcttccaaagggtctaccaaagacaagcccaataacctgggaaagcccaaggatagataagccttcctaccaggtatttatcattttcttagtccagatgtgatttgtcaatcaggatttcttttttttttttcttccagaagtagtgtcacctaggaacacagtagacctaccactttgctcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattga

SEQ ID NO: 16204 - DNA, 418 bp, Artificial Sequence; identical to SEQ ID NO: 11223
  Synthetic polypeptide

SEQ ID NO: 16205 - DNA, 386 bp, Artificial Sequence; identical to SEQ ID NO: 11224
  Synthetic polypeptide

SEQ ID NO: 16206 - DNA, 560 bp, Artificial Sequence; identical to SEQ ID NO: 6322
  Synthetic polypeptide

SEQ ID NO: 16207 - DNA, 457 bp, Artificial Sequence; identical to SEQ ID NO: 11225
  Synthetic polypeptide

SEQ ID NO: 16208 - DNA, 496 bp, Artificial Sequence; identical to SEQ ID NO: 11226
  Synthetic polypeptide

SEQ ID NO: 16209 - DNA, 385 bp, Artificial Sequence; identical to SEQ ID NO: 11229
  Synthetic polypeptide

SEQ ID NO: 16210 - DNA, 385 bp, Artificial Sequence; identical to SEQ ID NO: 11229
  Synthetic polypeptide

SEQ ID NO: 16211 - DNA, 2100 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16212 - DNA, 1875 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16213 - DNA, 2043 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16214 - DNA, 2046 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16215 - DNA, 1932 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16216 - DNA, 1479 bp, Artificial Sequence
  Synthetic polypeptide
ttctcaaagtgtgatccatgagccacctgaagcagagccaccctgggaaggtctgttttcaggcgcgtcccagaacacgtaaatcagatctaggctgtggagctagggagaagatgaatctgcagactgatcaggatcccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttga

SEQ ID NO: 16217 - DNA, 385 bp, Artificial Sequence; identical to SEQ ID NO: 11229
  Synthetic polypeptide

SEQ ID NO: 16218 - DNA, 2243 bp, Artificial Sequence; identical to SEQ ID NO: 8048
  Synthetic polypeptide

SEQ ID NO: 16219 - DNA, 1338 bp, Artificial Sequence; identical to SEQ ID NO: 8049
  Synthetic polypeptide

SEQ ID NO: 16220 - DNA, 1263 bp, Artificial Sequence; identical to SEQ ID NO: 8050
  Synthetic polypeptide

SEQ ID NO: 16221 - DNA, 418 bp, Artificial Sequence; identical to SEQ ID NO: 11223
  Synthetic polypeptide

SEQ ID NO: 16222 - DNA, 418 bp, Artificial Sequence; identical to SEQ ID NO: 11223
  Synthetic polypeptide

SEQ ID NO: 16223 - DNA, 418 bp, Artificial Sequence; identical to SEQ ID NO: 11223
  Synthetic polypeptide

SEQ ID NO: 16224 - DNA, 418 bp, Artificial Sequence; identical to SEQ ID NO: 11223
  Synthetic polypeptide

SEQ ID NO: 16225 - DNA, 418 bp, Artificial Sequence; identical to SEQ ID NO: 11223
  Synthetic polypeptide

SEQ ID NO: 16226 - DNA, 1391 bp, Artificial Sequence
  Synthetic polypeptide
ggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16227 - DNA, 1061 bp, Artificial Sequence
  Synthetic polypeptide
ggtgagcagcaggcgagtgagcaaagcttcatctgtatttacagtccctccccacggctctcattaccgcctgagctccacctcctgtcagatcagcagcagcattagattctcataggagtgtgaaccctactgtgaactgcacgtgtgagggatctaggttacatgctccttatgagaatctaattcctgacctgtcactgtctcccatcacccccatatgagaccatctagttgcaggaaaataagctcagggctcccactgattctacattatggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16228 - DNA, 938 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16229 - DNA, 1727 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16230 - DNA, 133 bp, Artificial Sequence; identical to SEQ ID NO: 6551
  Synthetic polypeptide

SEQ ID NO: 16231 - DNA, 2665 bp, Artificial Sequence; identical to SEQ ID NO: 7249
  Synthetic polypeptide

SEQ ID NO: 16232 - DNA, 1376 bp, Artificial Sequence; identical to SEQ ID NO: 9418
  Synthetic polypeptide

SEQ ID NO: 16233 - DNA, 1211 bp, Artificial Sequence; identical to SEQ ID NO: 9419
  Synthetic polypeptide

SEQ ID NO: 16234 - DNA, 1100 bp, Artificial Sequence; identical to SEQ ID NO: 9420
  Synthetic polypeptide

SEQ ID NO: 16235 - DNA, 1249 bp, Artificial Sequence; identical to SEQ ID NO: 9421
  Synthetic polypeptide

SEQ ID NO: 16236 - DNA, 2284 bp, Artificial Sequence
  Synthetic polypeptide
aaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 16237 - DNA, 2440 bp, Artificial Sequence
  Synthetic polypeptide
aaaaaaaatcacaggtatttacaggccattccaagtgccaaaagattgtttttgctcatggtgacttcagtatcacagatgttaggagacttgctgctatatgttaagaaagaagcacaaatgttgctgtagcccaaacttttttcctcatgtttcattgcatttcagcttaattggtttccctggtattcctatgtattttgtggagtgcttttaaaatcataagttggagtagaggtctttctgtgggcttcaccagactgccgagatcagggtcgaaacagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtctgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcggacatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactga

SEQ ID NO: 16238 - DNA, 1239 bp, Artificial Sequence; identical to SEQ ID NO: 9334
  Synthetic polypeptide

SEQ ID NO: 16239 - DNA, 5350 bp, Artificial Sequence; identical to SEQ ID NO: 655
  Synthetic polypeptide

SEQ ID NO: 16240 - DNA, 1325 bp, Artificial Sequence; identical to SEQ ID NO: 13366
  Synthetic polypeptide

SEQ ID NO: 16241 - DNA, 776 bp, Artificial Sequence; identical to SEQ ID NO: 13367
  Synthetic polypeptide

SEQ ID NO: 16242 - DNA, 467 bp, Artificial Sequence; identical to SEQ ID NO: 13368
  Synthetic polypeptide

SEQ ID NO: 16243 - DNA, 1521 bp, Artificial Sequence
  Synthetic polypeptide
tagaatgagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtga

SEQ ID NO: 16244 - DNA, 1323 bp, Artificial Sequence; identical to SEQ ID NO: 13303
  Synthetic polypeptide

SEQ ID NO: 16245 - DNA, 1470 bp, Artificial Sequence; identical to SEQ ID NO: 13304
  Synthetic polypeptide

SEQ ID NO: 16246 - DNA, 691 bp, Artificial Sequence; identical to SEQ ID NO: 13305
  Synthetic polypeptide

SEQ ID NO: 16247 - DNA, 728 bp, Artificial Sequence
  Synthetic polypeptide
aggagacagttggaaaagggctcacagagaagacagccatgagaagactgaagtgggtagagattgaagtcatgctgccacaagccaaagaacatctgaggatgccagaagctgaaaggggcgaggaagagacaagggagtctccccaagagccttcagagggagcatgccgttgctgatacatagatgttggtcttctagcctacggaattgaccctgtggatttagacatataccaaagctcccacatggtcgactatcagccctacaggaagcacaaatactccagggtcacgccgcaagagcaggcaaagctcgatgctcaactccgggacaaagagttttacaggcccatccctaaccccaaccccaagctaacagatgggtaccctgctttcaaaagaccccacatgactgccaaagacctgggactccccggcttcttcccatcacaggaacatgaggccacgagggaggacgagcgcaagttcaccagcacctgccatttcacatatccagcttcccacgatctgcacctggcccagggtgaccccaaccaggtcctccagagtgctgactttccgtgcctcgtggatcccaaacaccagcctgctgcagagatggccaaaggctacctgctactgccagggtgtccctgtcttcattgccatatagtcaaggtccccatcttgaaccggtggggacccttgatgccattttaccagtag

SEQ ID NO: 16248 - DNA, 919 bp, Artificial Sequence
  Synthetic polypeptide
cagccgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattggcaaagagtttaaaagaattgtccagagaatcaaggattttttgcggaatcttgtacccaggacagagtcctag

SEQ ID NO: 16249 - DNA, 978 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16250 - DNA, 1767 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16251 - DNA, 228 bp, Artificial Sequence
  Synthetic polypeptide
tgggggccccagtgagatattaatgccaccgggcaagagccggtcttgctccaggctcccccggaaggacggctggctcggagggggagcgccacctaagaattttcaggtccccgaagagtgaccgtcttccggaggagagcggattgactacggtgtgggtgccctaaaattcaacatctgagtcctcagcttctgaccccagggtcagttattgactctggatga

SEQ ID NO: 16252 - DNA, 735 bp, Artificial Sequence
  Synthetic polypeptide
caggagtccccagaccccaggcagcggaccagcactggtccgtggcctgttaggaaccaggccacatagcaggaggtaaggggcaggtgagcgatcattgccgcctgagctccgcctcctatcagaccagcggcagcattagattttcataggagtacaaaccctatcgtgaactgcgcatgcaggggatctaggttgcatgttccttatgagaatctaactaatgcctgttgatctgagggggaacagtttcatctagaaaccagcagccctccgccatccgtggaaaaattgtcttccacgaaactggtctctggtgccaaaaaggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaa

SEQ ID NO: 16253 - DNA, 551 bp, Artificial Sequence
  Synthetic polypeptide
ggccaggtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaa

SEQ ID NO: 16254 - DNA, 835 bp, Artificial Sequence; identical to SEQ ID NO: 6764
  Synthetic polypeptide

SEQ ID NO: 16255 - DNA, 624 bp, Artificial Sequence; identical to SEQ ID NO: 9709
  Synthetic polypeptide

SEQ ID NO: 16256 - DNA, 441 bp, Artificial Sequence
  Synthetic polypeptide
gcgcggtgactcacacctgtaatcccagcactttgggaggccaaggcaggcggatcacgaggtcagaagatcgagaccatcctagctaacaagcatttctttgaaggtgttgaagctcgcgtggcacagggcataagggaggaggaagtaagttaccaacttgcatttaacaaacaagaacttcgtaaagtcattaaggagtaccctggaaaggaagtaaaaaaaggtctagataacctctacaagaaagttgataaacatttatgtgaagaagagaacttacttcaggtggtgtggcactccatgcaagatgaatttatacgccagtataagcactttgaaggtttgatagctcgctgttatcctggatctggtgttacaatggaattcactattcaggacattctggattattgttccagcattgcacagtcccactaa

SEQ ID NO: 16257 - DNA, 917 bp, Artificial Sequence
  Synthetic polypeptide
ctctccctctccctctccctctccctctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcacgcgccgccacgcctgattggttttggtggagacggggtttcgctgtgttggccgggccggtctccagcccctaaccgcgagtgatccgccaacctcggcctcccgaggtgccgggattgcagatggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagcgtctctgcctggccgcccatcgtctgggatgtgaggagcccctctgcccggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaatcctcctgcatatgcccaagaggattgggagtggaatggacaccagcagaagcaccacagttattcctgtag

SEQ ID NO: 16258 - DNA, 1014 bp, Artificial Sequence
  Synthetic polypeptide
ctctcccctctcccttctcccctctcccctctccctctcggtctccctctccctctctttccactgtctccctctgatgccgagccgaagctggactgtactgctgccatctcggctcactgcaacctccccgcctgattctcctgcctcagcctgcccagtgcctgcgattgcaggcgcgcgccaccacgcctgactggttttcgtacttttttggtggagatggggtttcgctgtgttggccgggctggtctccagctcctaaccgcgagtgatccgccagcctcggcctcccgaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgccccgccgccatcccgtctaggaagtgaggagcgcctcttcccggcagccatcccatctgggaagtgaggagcgtctctgcccggccgcccatcgtctgagatgtggggagcgcctctgccccgccgccccgtctgggatgtgaggagcgcctctgccaggctgcgaccccgtctgggaggtgaggagcgtctctgcccagccgccccgtctgagaagtgaggagcccctccgcccggcagctgccccgtctgagaagtgaggagcccctctgcccggcagccaccccgtctgggaaggagaagtgaattcaaacggtgctggaagggtcaaggggcctgccaaacttactgcacaaggcaagaaacttacatgcacctgtgcccggatgcgtccctgtgctgtctctcctatgcattgaaacctccaccggtccccaagcatgaatatgagtag

SEQ ID NO: 16259 - DNA, 239 bp, Artificial Sequence
  Synthetic polypeptide
aggaagaactagaactgaatttatttacaggcagtatgatcttgtatgtagaagacctggaagaatctacaaagaagctaccagaataagtcatgaatgaaaaacttcagcactgcatggaactaacagatctaatgcggaatcacctgaatgagaagagggcactccgcttggagtggatgattgtcatcctcattaccatagaggtaatgtttgagctgggacgagtatttttctga

SEQ ID NO: 16260 - DNA, 1656 bp, Artificial Sequence
  Synthetic polypeptide
ggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 16261 - DNA, 1512 bp, Artificial Sequence
  Synthetic polypeptide
ggaaatgagaaacaagccattggaaactggagtaaaggccattcttgtcatacagttgctaagaacttggtggaaatgtatctatgtcttaggactttacggaaagcagaaattaagagcaataattcaggatatctggtggaagaaatatctaagccgcaaagcatttaggctgctgtgtggctacttttaactgcatacagtaagaggcaggagggaaaaaaatgacttaaaaatggaatttataattaaaagagaagcagaatagaaagatttggaaaattcactgcctagccatataaaaagtgaaaaggcatgaatgggagaaaatactaagggtgtggcctagtgaccattgttaaagagattaatatggatagaagggagtgaagtactattcaagaagttgagaaaaaggccctgaaggcatttcaaagcctttgaggctgcccctcccatcataggctcagagctcagagggcaaattgatttcaggggaaactagaatgccctttacaggcttgctgcccagatctgcctcaggtttctgttctctgaattccagcacagtgctccttagctgctccagccatggctcaagtgagcccaggtgcagttcaacccaccactccataaggtgcaattggtaagccttggtggcacccacttgctaagtgtgcaggctagcagaatgcaagaggtgtggaacacaacttcctccatgtagatttcaaaggatgttgtggacagcctgagggcccaggaagagtccactcccatgtcagtgcctagtagagccatgggagtggactgccactgagaccccagaactgtggagctattagcctgaagcattagcctgggagagctgcagggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 16262 - DNA, 2314 bp, Artificial Sequence
  Synthetic polypeptide
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagcagaaaaacctgcaagagtatcaaaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaa

SEQ ID NO: 16263 - DNA, 2290 bp, Artificial Sequence
  Synthetic polypeptide
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagaaaaagaagatatcaaaaagaaaagtgagaaggaaactgccattgatgtggaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaattaaaaaagctgtacctggaaagaaggaagagaaaacaaccaagacagtggagcaagaaattagaaaagaaaaatctgggaagacttcttcaattctgaaagataaagaacctattaaagggaaagaagagaaagttccagcttccctaaaggaaaaagaacctgaaactaaaaaagatgaaaagatgtccaaagcaggcaaagaagtcaagcctaaacctccacaactacaaggaaaaaaggaagagaagccagagccccaaattaaaaaagaagcaaaaccagctatatctgaaaaagtgcaaatacacaaacaagacatagtgaaaccagaaaagactgtttctcatggtaaaccagaagaaaaagttctcaagcaggtaaaagctgtcacaatagaaaaaacagccaagcccaaaccaacaaaaaaagctgaacatcgagaaagagaacctccatctataaaaacagacaaaccaaaaccaactccaaaaggaacatcagaagtcacagaatcaggaaagaagaaaactgaaatatctgaaaaagaaagtaaagaaaaagcagacatgaagcatcttagagaagaaaaagtctcaacaagaaaagaaagtcttcaattacacaatgtgacaaaagaagatgttgaagatgtaccagcttcaaagaaagctaaagaaggaactgaagatgtgtctcccacaaagcagaaaagtcccatcagtttcttccagtgtgtctacttggatgggtacaatggctatggatttcagtttcctttcactcctgcagaccgccctggagagagctctggtcaagcaaattctccaggacagaagcaacaaggacagtaa

SEQ ID NO: 16264 - DNA, 1018 bp, Artificial Sequence
  Synthetic polypeptide
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacactggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggacaaagcccagccattccacctcccttaccgacagaacaagcttccagacccactccggcatcacctgcccttgaaggcaagtacttttttttttcttaa

SEQ ID NO: 16265 - DNA, 628 bp, Artificial Sequence
  Synthetic polypeptide
tttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaaggaaaatacaaactaaagaagttggacacagctcttga

SEQ ID NO: 16266 - DNA, 2792 bp, Artificial Sequence
  Synthetic polypeptide
ccctgcccctgcccctgcccctgcccctgcctctgcctctgcctctgcctcgtctccctctgatgccgagccaaacctggactgtactgctgccatctcggctcactgcaacctccctgcctgattctcctgcctcagcctgccgagtgcctgcgattgcaggcgcacgccgccacgcctgactggttttcgttttttttttggtggagacggggttttgctctgttggccgggctggtctccagctcctaaccgcgagtgatccgccagcctcggcctcccgaggtgccgggattgcagacggagttcgttcactcagtgctcaatggtgcccaggctggagtgcagtggcgtgatctcggctcgctacaacctccacctcccagccgcctgccttggcctcccaaagtgccgagattgcagcctttgcccagccgccaccccgtctgggaagtgaggagcgtctctgcctggccccccatcgtctgggatatgaggagcctctctgcctggctgcacagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 16267 - DNA, 2590 bp, Artificial Sequence
  Synthetic polypeptide
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataa

SEQ ID NO: 16268 - DNA, 1924 bp, Artificial Sequence
  Synthetic polypeptide
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccagattcatgaagagaaactcctctactggaacatggctgttcgagacttcagtatcctcatcaacttga

SEQ ID NO: 16269 - DNA, 2530 bp, Artificial Sequence
  Synthetic polypeptide
cctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggagtcaccccagactatgtccctcctcttggaaactttgatgtggaaactttagatataacacctcatactgttactgctatttcagcaaaaatcagaaagaaaggaaaaatagaaaggaaacaaaaaacagatggcagcaagacatcctcctctgacacactttcagaagagaaaaattcagaatgtgaccctacgccatctcatagaggccagctaaacaaggagttcacagggaaggaagaaaagacatcattgttactacataattcccatgcttttttccgagagctggacattgaggtcttctctattctacattgtggacttgtgacgaagttcatcttagatactgaaatgcacactgaagctacagaagttgtgcaacttgggccccctgagctgcttttcttgctggaagatctctcccagaagctggagagtatgctgacacctcctattgccaggagagtcccctttctcaagaacaaaggaagccggaatattggattctcacatctccaacagagatctgcccaagaaattgttcattgtgtttttcaactgctgaccccaatgtgtaaccacctggagaacattcacaactattttcagtgtttagctgctgagaatcacggtgtagttgatggaccaggagtgaaagttcaggagtaccacataatgtcttcctgctatcagaggctgctgcagatttttcatgggctttttgcttggagtggattttctcaacctgaaaatcagaatttactgtattcagccctccatgtccttagtagccgactgaaacagggagaacacagccagcctttggaggaactactcagccagagcgtccattacttgcagaatttccatcaaagcattcccagtttccagtgtgctctttatctcatcagacttttgatggttattttggagaaatcaacagcttctgctcagaacaaagaaaaaattgcttcccttgccagacaattcctctgtcgggtgtggccaagtggggataaagagaagagcaacatctctaatgaccagctccatgctctgctctgtatctacctggagcacacagagagcattctgaaggccatagaggagattgctggtgttggtgtcccagaactgatcaactctcctaaagatgcatcttcctccacattccctacactgaccaggcatacttttgttgttttcttccgtgtgatgatggctgaactagagaagacggtgaaaaaaattgagcctggcacagcagcagactcgcagcagattcatgaagagaaactcctctactggaacatggctgttcgagacttcagtatcctcatcaacttgataaaggtatttgatagtcatcctgttctgcatgtatgtttgaagtatgggcgtctctttgtggaagcatttctgaagcaatgtatgccgctcctagacttcagttttagaaaacaccgggaagatgttctgagcttactggaaaccttccagttggacacaaggctgcttcatcacctgtgtgggcattccaagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcagggtgaagagattaagtcccaaaattcccaggagagcacagcagatgagagtgaggatgacatgtcatcccaggcctccaagagcaaagccactgaggatggtgaagaagacgaagtaagtgctggagaaaaggagcaagatagtgatgagagttatgatgactctgattag

SEQ ID NO: 16270 - DNA, 1397 bp, Artificial Sequence; identical to SEQ ID NO: 14804
  Synthetic polypeptide

SEQ ID NO: 16271 - DNA, 1331 bp, Artificial Sequence; identical to SEQ ID NO: 14805
  Synthetic polypeptide

SEQ ID NO: 16272 - DNA, 167 bp, Artificial Sequence; identical to SEQ ID NO: 10038
  Synthetic polypeptide

SEQ ID NO: 16273 - DNA, 334 bp, Artificial Sequence
  Synthetic polypeptide
ccagcccgtgccagatcgacagaatctagaagttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataa

SEQ ID NO: 16274 - DNA, 1737 bp, Artificial Sequence; identical to SEQ ID NO: 905
  Synthetic polypeptide

SEQ ID NO: 16275 - DNA, 284 bp, Artificial Sequence; identical to SEQ ID NO: 906
  Synthetic polypeptide

SEQ ID NO: 16276 - DNA, 856 bp, Artificial Sequence; identical to SEQ ID NO: 907
  Synthetic polypeptide

SEQ ID NO: 16277 - DNA, 802 bp, Artificial Sequence; identical to SEQ ID NO: 908
  Synthetic polypeptide

SEQ ID NO: 16278 - DNA, 561 bp, Artificial Sequence; identical to SEQ ID NO: 909
  Synthetic polypeptide

SEQ ID NO: 16279 - DNA, 582 bp, Artificial Sequence; identical to SEQ ID NO: 910
  Synthetic polypeptide

SEQ ID NO: 16280 - DNA, 1189 bp, Artificial Sequence
  Synthetic polypeptide
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaactccttgacctgtttatggtttgggattggtctacttacctagctgattatgggcagccagcttctaagtaccttcgggtgaatccaaacacagcccttactcttttggagaagatgaaggatactagcaaaaagaacaatatatttgctcagttcaggaagaatgatcgagacaaacagaagttgatagagacagtcgtgaaacagctgagaagtttggtgaatggtatgtcccagcacatgtag

SEQ ID NO: 16281 - DNA, 958 bp, Artificial Sequence
  Synthetic polypeptide
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatatgaggtgttgctgtgttgcccagactggtctcaaactcctggcctcaagtcatcctcctgccttggcatcccaaaatgctggaattag

SEQ ID NO: 16282 - DNA, 943 bp, Artificial Sequence
  Synthetic polypeptide
tctccctctcccgtctccctctccccacggtctccctctccctctctttccacgtctccctctgatgccgagccgaagctgcactgtactgctgccatctcggctcactgcaacctccctgcctgattctcctgcctcagcctgccgagtgcctgcgattgcaggcgcacgccaccacgcctgactggttttcgtatttttttggtggagacggggtttcgctgtgttggccgggctggtctccagctcctaaccgcgagtgatccgccagcctcggcctcccgaggtgccgggattgcagatggagtctggttcactcagtgctcaatggtgcccaggctggagtgcagtggcgtgctctcggctcgctacaacctccacctcccagccacctgccttggcctcccaaagtgccgagattgcagcctctgcccggccgccaccccgtctgggaagtgaggagcgtctctgcctggtcgcccattgtctgggacgtgaggagcccctctgcctggctgcccagtctggaaagtgaggagcgtctctgcccggccaccatcccatctaggaagtgaggagcgcctcttcccggccgccatcccatgtacgaagtgaggagcgtctctgcctggccgcccatcgtctgagatgtggggagcgcctctgccccgccaccccgtctgggatgtgaggagcgcctctacccggccgcgaccccgtctgggaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaattgtttgccagctctgagcctgtgccaggattccagggggataccctgcagctagcattcattgacctcagacaa

SEQ ID NO: 16283 - DNA, 3243 bp, Artificial Sequence; identical to SEQ ID NO: 12893
  Synthetic polypeptide

SEQ ID NO: 16284 - DNA, 878 bp, Artificial Sequence; identical to SEQ ID NO: 12894
  Synthetic polypeptide

SEQ ID NO: 16285 - DNA, 545 bp, Artificial Sequence; identical to SEQ ID NO: 12895
  Synthetic polypeptide

SEQ ID NO: 16286 - DNA, 877 bp, Artificial Sequence; identical to SEQ ID NO: 12896
  Synthetic polypeptide

SEQ ID NO: 16287 - DNA, 498 bp, Artificial Sequence; identical to SEQ ID NO: 12897
  Synthetic polypeptide

SEQ ID NO: 16288 - DNA, 615 bp, Artificial Sequence; identical to SEQ ID NO: 12898
  Synthetic polypeptide

SEQ ID NO: 16289 - DNA, 427 bp, Artificial Sequence; identical to SEQ ID NO: 573
  Synthetic polypeptide

SEQ ID NO: 16290 - DNA, 1662 bp, Artificial Sequence
  Synthetic polypeptide
gcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccagattggatcattgctattccatggatgactcagaggatacatcctgggactttggtccacaagcatttaagcttttgtctgctgtggacatcttaggcgaaaaatttggaattgggcttccaattttatttctccgaggatctaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaagggtagaaattggcttcataaagctaatacagaatctcagagcctcatccttcaagctaatgaagaattgtgtccaaagaagttgcttctgcctagttcgaaaactgtatcttcgggcaccaaagagcattgttataatcaagtaccagttgaattaagtacagagaagaagtctaacttggagaagttatattcttataaaccatgtgataagatttcttctgggagtaacatttctaaaaaaagtatcatggtacagtcaccagaaaaagcttacagttcctcacagcctgttatttcggcacaagagcaggagactcagattgtgttatatggcaaattggtagaagctaggcagaaacatgccaataaaatggatgttcccccagctattctggcaacaaacaagatactggtggatatggccaaaatgagaccaactacggttgaaaacgtaaaaaggattgatggtgtttctgaaggcaaagctgccatgttggcccctctgttggaagtcatcaaacatttctgccaaacaaatagtgttcagacagacctcttttcaagtacaaaacctcaagaagaacagaagacgagtctggtagcaaaaaataaaatatgcacactttcacagtctatggccatcacatactctttattccaagaaaagaagatgcctttgaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaa

SEQ ID NO: 16291 - DNA, 357 bp, Artificial Sequence; identical to SEQ ID NO: 10751
  Synthetic polypeptide

SEQ ID NO: 16292 - DNA, 956 bp, Artificial Sequence; identical to SEQ ID NO: 7135
  Synthetic polypeptide

SEQ ID NO: 16293 - DNA, 2681 bp, Artificial Sequence
  Synthetic polypeptide
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccatag

SEQ ID NO: 16294 - DNA, 2684 bp, Artificial Sequence
  Synthetic polypeptide
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggattaatatcttttcaagaatttgttgcctttgaatctgtcctgtgtgcccctgatgctttgtttatggtagcctttcagctgtttgacaaagctggcaaaggagaagtaacttttgaggatgttaagcaagtttttggacagaccacaattcatcaacatattccatttaactgggattcagaatttgtgcaactacattttggaaaagaaagaaaaagacacctgacatatgcggaatttactcagtttttattggaaatacaactggagcacgcaaagcaagcctttgtgcaacgggacaatgctaggactgggagagtcacagccatcgacttccgagacatcatggtcaccatccgcccccatgtcttgactccttttgtagaagaatgtctagtagctgctgctggaggtaccacatcccatcaagttagtttctcctattttaatggatttaattcgctccttaacaacatggaactcattagaaagatctatagcactctggctggcaccaggaaagatgttgaagtgactaaggaggagtttgttctggcagctcagaaatttggtcaggttacacccatggaagttgacatcttgtttcagttagcagatttatatgagccaaggggacgtatgaccttagcagacattgaacggattgctcctctggaagagggaactctgccctttaacttggctgaggcccagaggcagcagaaggcctcaggtgattcagctcgaccagttcttctacaagttgcagagtcggcctacaggtttggtctgggttctgttgctggagctgttggagccactgctgtgtatcctatcgatcttgtaaaaactcgaatgcagaaccaacgatcaactggctcttttgtgggagaactcatgtataaaaacagctttgactgttttaagaaagtgctacgctatgaaggcttctttggactgtatagaggtctgttgccacagttattgggagttgccccagagaaggccataaaacttacagtgaacgattttgtgagggataaatttatgcacaaagatggttcggtcccacttgcagcagaaattcttgctggaggctgcgctggaggctcccaggtgattttcacaaatcctttagaaatcgtcaagatccgtttgcaagtggcaggagaaatcaccactggtcctcgagtcagtgctctgtctgtcgtgcgggacctggggttttttgggatctacaagggtgccaaagcatgctttctgcgggacattcctttctcggccatctactttccgtgctatgctcatgtgaaggcttcctttgcaaatgaagatgggcaggttagcccaggaagcctgctcttagctggtgccatagctggtatgcctgcagcatctttagtgacccctgctgatgttatcaagacgagattacaggtggctgcccgggctggccaaaccacttacagcggagtgatagactgctttagaaagatactgcgtgaagaaggaccaaaagctctgtggaagggagctggtgctcgtgtatttcgatcctcaccccagtttggtgtaactttgctgacttacgaattgctacagcgatggttctacattgattttggaggagtaaaacccatgggatcagagccagttcctaaatccaggatcaacctgcctgccccgaatcctgatcacgttgggggctacaaactggcagttgctacatttgcagggattgaaaacaaatttggactttacctacctctcttcaagccatcagtatctacctcaaaggctattggtggaggcccatag

SEQ ID NO: 16295 - DNA, 875 bp, Artificial Sequence
  Synthetic polypeptide
gagcgacaggactagctggaattcctaggccgactaagaattcctaagcctagctgggaaagctgatcacacctacttttgaacacggggcttgtaactcagctcacacccaaccaatcaggtaataaagagggctctctaaaatacaaattaggctaaagcaggaggtaaagaaatagtcaaatcacatatcgcctgagagcgcagggggagggacaatgatcagactataaacccaggcattcgaacagggagtgggcaaccccctttgggtcccctcccattgtatgggagctctgttttcactctattaaatgttgcaactgcatactcttctggtccgtgtttgttatggctcaagctgagctttcactcactgtccaccactgttgtttgcccacatcgcagacccgccgctgacttccacccctctggatccggcagggtgtccgctgtccatggaggcacccattactgctcccgatccggctaaaggctcgccattgtttctgcacggctaagtgcccaggttcgtcccaatcgagctgaacactggtctctaggttccacggttctcttctgtgacccacggcttctaatagagctgtaacactcaccgcatggcccaaagttccattccttggaatccatgaagccaagaaccccaggtggctttaaccaagagagcagatccagctgagcttagaacaatatttttgaagtatgcaagcattgagaaaaacggtgaatttttcatgtcccccaatgactttgtcactcgatacttgaacatttttggagaaagccagcctaatccaaagactgtggaacttttaagtggagtggtggatcagaccaaagatggaggatgttaa

SEQ ID NO: 16296 - DNA, 470 bp, Artificial Sequence; identical to SEQ ID NO: 9114
  Synthetic polypeptide

SEQ ID NO: 16297 - DNA, 134 bp, Artificial Sequence; identical to SEQ ID NO: 9115
  Synthetic polypeptide

SEQ ID NO: 16298 - DNA, 36 bp, Artificial Sequence; identical to SEQ ID NO: 12516
  Synthetic polypeptide

SEQ ID NO: 16299 - DNA, 217 bp, Artificial Sequence; identical to SEQ ID NO: 12517
  Synthetic polypeptide

SEQ ID NO: 16300 - DNA, 52 bp, Artificial Sequence; identical to SEQ ID NO: 12518
  Synthetic polypeptide

SEQ ID NO: 16301 - DNA, 172 bp, Artificial Sequence; identical to SEQ ID NO: 12519
  Synthetic polypeptide

SEQ ID NO: 16302 - DNA, 154 bp, Artificial Sequence; identical to SEQ ID NO: 12520
  Synthetic polypeptide

SEQ ID NO: 16303 - DNA, 20 bp, Artificial Sequence
  Synthetic polypeptide
ttaacatccttgtttattga

SEQ ID NO: 16304 - DNA, 174 bp, Artificial Sequence; identical to SEQ ID NO: 12522
  Synthetic polypeptide

SEQ ID NO: 16305 - DNA, 148 bp, Artificial Sequence; identical to SEQ ID NO: 12523
  Synthetic polypeptide

SEQ ID NO: 16306 - DNA, 575 bp, Artificial Sequence
  Synthetic polypeptide
cccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgagacttcatctgcagagagaaagagacgattacctgtgtggtttgccaaaggaagtgataccagcaagaaattaatggacaaaacgaaaaggggaggtctttttagttaa

SEQ ID NO: 16307 - DNA, 446 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagagtttaaagattttcaacgacgaattcttgtggctaccaacctatttggccgaggcatggacatcgagcgggtga

SEQ ID NO: 16308 - DNA, 674 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcggtgctaccctctgtctccctccaggtggccagagcaggccggtttggcaccaagggcttggctatcacatttgtgtccgatgagaatgatgccaagatcctcaatgatgtgcaggatcgctttgaggtcaatattagtgagctgcctgatgagatag

SEQ ID NO: 16309 - DNA, 683 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacagacacggtag

SEQ ID NO: 16310 - DNA, 666 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccaggaggagaggctttctcggtatcagcagtttaaagattttcaacgacgaattcttgtggctaccaacctatttggccgaggcatggacatcgagcgggtgaacattgcttttaattatgacatgcctgaggattctgacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctaca

SEQ ID NO: 16311 - DNA, 367 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccaggtggtgatctttgtgaagtctgtgcagcggtgcattgccttggcccagctactagtggagcagaacttcccagccattgccatccaccgtgggatgccccagga

SEQ ID NO: 16312 - DNA, 263 bp, Artificial Sequence
  Synthetic polypeptide
tggtgtgtgcctgtagtcccagctattcaggagactgaagcaggaggatcacttgagcccaggaatttgaggctatagtgtgctatgattgtgccagtgaatagccactgcactccagcctgggcaacatgccaatggagatcttcgtggatgatgagacgaagttgacgctgcatgggttgcagcagtactacgtgaaactgaaggacaacgagaagaaccggaagctctttgaccttctggatgtccttgagttcaaccag

SEQ ID NO: 16313 - DNA, 1234 bp, Artificial Sequence; identical to SEQ ID NO: 13601
  Synthetic polypeptide

SEQ ID NO: 16314 - DNA, 961 bp, Artificial Sequence; identical to SEQ ID NO: 6722
  Synthetic polypeptide

SEQ ID NO: 16315 - DNA, 1445 bp, Artificial Sequence; identical to SEQ ID NO: 15858
  Synthetic polypeptide

SEQ ID NO: 16316 - DNA, 1472 bp, Artificial Sequence; identical to SEQ ID NO: 15859
  Synthetic polypeptide

SEQ ID NO: 16317 - DNA, 797 bp, Artificial Sequence; identical to SEQ ID NO: 15860
  Synthetic polypeptide

SEQ ID NO: 16318 - DNA, 1174 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaaggcaggtcgctgcctgtgccccagctggtgcccgagaccgaggacgagaagaagcgctttgaggaaggcaaagggcggtacctgcagatgaaggcgaagcgacagggccacgcggagcctcagccctag

SEQ ID NO: 16319 - DNA, 1009 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaagctcacgtaatgcctgctggcgctgaccacacagctccttcctcctctcccagcactggcacgaagtgctccctgctgcgtcatcaccatctcgggacgcatgaccttcacgagcaataa

SEQ ID NO: 16320 - DNA, 898 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaagctccttag

SEQ ID NO: 16321 - DNA, 1047 bp, Artificial Sequence
  Synthetic polypeptide
ctctccctctccccctccccctccccctctccccacggtctccctctccctctcttgccacggtctccctctgatgccgagccgaagctggactgtgctgctgccatcttggctcactgcaacctccctgcctgattctcctgcctcagcctgccgagtgcctgcgattgcaggcgcgcgccgccacgcctgactggttttcgtatttttttggtggagacggggtttcgctgtgttggccgggctggtctccagctcctaaccgcgagtgatccgccagcctcggcctcccgaggtgccgggattgcagacggagtctcgttcactcagtgctcaatggtgcccaggctggagtgcagtggcgtgatctcggctcgctacaacctccacctcccagctgcctgccttggccccccaaagtgccgagattgcagcctctgcccggccaccaccccgtctgggaagtgaggagcgtctctgcctggccgcccgtcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccgccccgtctgggatgtgaggagcgtctctgcccggccgccccgtctgagaagtgaggagaccctctgcctggcaaccgccccgtctgagaagtgagaagcccctccgcccggcagccaccccgtctgggaagtgtgaccatgaagctcatggatgaggtcgccgggatcgtggctgcacgccactgcaagaccaacatcgtcacagcttccgtggacgccattaattttcatgacaagatcagaaaaggctgcgtcatcaccatctcgggacgcatgaccttcacgagcaataagtccatggagatcgaggtgttggtggacgccgaccctgttgtggacagctctcagaagcgctaccgggccgccagtgccttcttcacctacgtgtcgctgagccaggaagg

SEQ ID NO: 16322 - DNA, 1969 bp, Artificial Sequence
  Synthetic polypeptide
ccccagacctctcacccaggaccccaagtgtgcacctttgaagccattgtcttcactcctgactgatagatcggggatccaatggattctgaacacaagcagtttgctctgtgactgccatttgaagtggctacttcaatggttggttgataataactttcaacattctgtgaatgtaagctgtgcacaccctgaatggctagcagggcaaagcatcctgaatgtggatctgaaagattttgtctgtgatgattttctcaagccacagataaggacacatcctgaaaccataattgctctaagaggcatgaatgtgactctgacgtgcactgcagtgagcagcagtgattcacccatgtccactgtgtggcgcaaagacagtgaaatcctgtatgacgtggatactgagaattttgttcgttattggcagcaagctggagaagctctggaatatactagtatcttacatcttttcaatgtgaatttcacagatgaaggaaaatatcagtgtattgttactaatcactttggttctaattattctcagaaagccaaactgactgtaaatgagatgccatcttttctgaaaacgccaatggatctgactattcgcactggtgccatggccagattagaatgtgctgcagagggacaccctgcacctcagatttcctggcagaaagatggtggtactgactttcctgcggctcgagaaagacgcatgcacgtcatgcccgaggatgacgtcttctttattgccaatgtgaaaatagaagatatgggaatctatagctgcatggcacaaaatacagcaggaggtctctcagcaaatgcttccctaacagtgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacagaggagctcaatctgcctgcagacattcccagctacttgtcttcccaaggaacgctgtctgagccacaggaaggctacagcaactctgaggcaggcagtcatcagcaacttatgcctcctgccaatggatatatacacaaaggcactgacggtggcactggtacccgggtgatttgctcagattgttatgacaatgccaacatctactccaggacccgagaatactgtccatacacctatattgctgaggaggacgttcttgatcagacactgtccagcctcatggtccaaatgcctaaagagacatatttagtacatcctccccaggatactactgccctagagagcctgataccgtcagccaacagagagccatctgcctttcccaccaaccatgagaggataagtgagaagaaacttccctccacacagatgagcggtgaaacattgcagcggcccgtgtggaacataaacagagaactaggcctgcctcatcctcctttttcccagcagccagtccatgagtcaccacaacttcatcaaaatgagggcctggcagggagagagccagactgttctgcttcttccatgtcctgccacaggttacaggatcatgcttttgattttagtaggactcggaacattcaagatggtagtgagggcacatga

SEQ ID NO: 16323 - DNA, 1530 bp, Artificial Sequence; identical to SEQ ID NO: 7238
  Synthetic polypeptide

SEQ ID NO: 16324 - DNA, 369 bp, Artificial Sequence; identical to SEQ ID NO: 7239
  Synthetic polypeptide

SEQ ID NO: 16325 - DNA, 342 bp, Artificial Sequence; identical to SEQ ID NO: 7240
  Synthetic polypeptide

SEQ ID NO: 16326 - DNA, 1419 bp, Artificial Sequence; identical to SEQ ID NO: 7241
  Synthetic polypeptide

SEQ ID NO: 16327 - DNA, 190 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccagaggaactagaacgggacaagagggtcacttggattgtggagttctttgccaattggtctaa

SEQ ID NO: 16328 - DNA, 655 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccatgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataa

SEQ ID NO: 16329 - DNA, 190 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccactctctccttcctgcttcctccttgctgtggtggctgggatgcttcttccatgattttttga

SEQ ID NO: 16330 - DNA, 139 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccagtacaaagtga

SEQ ID NO: 16331 - DNA, 769 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataa

SEQ ID NO: 16332 - DNA, 226 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccatgccccatgaagagggacaaagaatgggatataggagtgcacagcccagcctgacctgtgacatctctgtgtttcagtcactgtggagcaacatatag

SEQ ID NO: 16333 - DNA, 133 bp, Artificial Sequence
  Synthetic polypeptide
taatatggctcccaacgttggcctcagagaagactcagaaccccaaaggagttgcccgagactggagagagaagtggagatcctgatgtttctcagtgccattgtgatgatgaagaaccgcagatccagctga

SEQ ID NO: 16334 - DNA, 896 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16335 - DNA, 962 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16336 - DNA, 1031 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16337 - DNA, 890 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16338 - DNA, 277 bp, Artificial Sequence
  Synthetic polypeptide
attgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggcaaaagtcaacaactctagcttaattggagtaggctatactcagactctgaggcctggtgtgaagcttacactctctgctctggtagatgggaagagcattaatgctggag

SEQ ID NO: 16339 - DNA, 315 bp, Artificial Sequence
  Synthetic polypeptide
attgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggcaaaagtcaacaactctagcttaattggagtaggctatactcagactctgaggcctggtgtgaagcttacactctctgctctggtagatgggaagagcattaatgctggaggccacaaggttgggctcgccctggagttggaggcttaa

SEQ ID NO: 16340 - DNA, 1082 bp, Artificial Sequence
  Synthetic polypeptide
ttcccccagccctctactcattcttcaggttggagcttaggattgtctccttcaggttgcctttcctgactgtgctactgcgttcccctcccccactagagcacacatcaccctgtgtggcaattccctgtttacatgtcttgttttccccactagaccataagccacaagggggagggactcttgtcttatccgtcgtcattattcctgctgcttattgaaggtgttgcctgccacagagaagacctcactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctga

SEQ ID NO: 16341 - DNA, 819 bp, Artificial Sequence; identical to SEQ ID NO: 13668
  Synthetic polypeptide

SEQ ID NO: 16342 - DNA, 885 bp, Artificial Sequence; identical to SEQ ID NO: 13669
  Synthetic polypeptide

SEQ ID NO: 16343 - DNA, 954 bp, Artificial Sequence; identical to SEQ ID NO: 13670
  Synthetic polypeptide

SEQ ID NO: 16344 - DNA, 813 bp, Artificial Sequence; identical to SEQ ID NO: 13671
  Synthetic polypeptide

SEQ ID NO: 16345 - DNA, 1131 bp, Artificial Sequence
  Synthetic polypeptide
cagtgattctcaaactcaagagcctcgggttctggcaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 16346 - DNA, 574 bp, Artificial Sequence
  Synthetic polypeptide
cagcactttgggaggctgagatgggtggatcatttgaggtcaggagttcgagaccagcttggccaacgtggtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatga

SEQ ID NO: 16347 - DNA, 1058 bp, Artificial Sequence; identical to SEQ ID NO: 13964
  Synthetic polypeptide

SEQ ID NO: 16348 - DNA, 970 bp, Artificial Sequence; identical to SEQ ID NO: 711
  Synthetic polypeptide

SEQ ID NO: 16349 - DNA, 658 bp, Artificial Sequence
  Synthetic polypeptide
ggccaggcacggtggctcatgcctgtaatcctagcacttcgggaggctgaggtacctaaaacagatccaggacctgcccccaactggcctccctgagatgaacctgctggagatgtacagcctgaaggatgagatgggcaacctcaggaagttactagagtctaccccatcgccagtcgtcttctgccacaatgacatccaggaagggaacatcttgctgctctcagagccagaaaatgctgacagcctcatgctggtggacttcgagtacagcagttataactataggggctttgacattgggaaccatttttgtgagtgggtttatgattatactcacgaggaatggcctttctacaaagcaaggcccacagactaccccactcaagaacagcagttgcattttattcgtcattacctggcagaggcaaagaaaggtgagaccctctcccaagaggagcagagaaaactggaagaagatttgctggtagaagtcagtcggtatgctctggcatcccatttcttctggggtctgtggtccatcctccaggcatccatgtccaccatagaatttggttacttggactatgcccagtctcggttccagttctacttccagcagaaggggcagctgaccagtgtccactcctcatcctga

SEQ ID NO: 16350 - DNA, 1791 bp, Artificial Sequence
  Synthetic polypeptide
aaaaacctctctcgttccttctcctcctccagctcctgcctcatttctctcattccctttaaggtaaaacacctcagaaaagctgtcgatgctggctatctccagttctggtcctctcatcctctcttgaaccactctgtttaggattttgaccccttgccttaacaaaaccattctcttaggacactcaatgaccttcccagtattaaaccccatgcttgactttcagttctcaacttccttgacttttcagcagcatttaggacacttgacttttcctgcctcctgcagaggctttcttcacctgcttgcagatgcaccctctctaggttctccctgctccttctcagtgtcctttgttagttcctcctcatttcccaggctccacccttggcctccaccttttttcctacttcctggtgccctcatccactcttgtgtctgaatgtcctctatatgctgatctcttgcctggactctcccctggaatccagactcctatatacaaccgcctgctctacatctccactgaaatatctcatgggtgcctgaaacttaaatatatccaaaactaaattcctaaactcagcagtatccccaaaagctgctgctttcccttttcagttaatggcgattccatcctgtagctgctgttcaggccaaaaaacatgactcatcctcaaacatccctcctataccttacttcctatccctcagcagatgctttaaaatatagccaggatccaagcactgctgcaaactcctcgactcccaccctgggcccaagccagtcatcagctcttgcctggatgataacaacagccggttactgctcccctgcttctgcggcttgcctcctccatctgttttcaacacagcaatcagagtgctgaaaacgtcactcctggaagcaaggcggctctagctaatttatgtattggagatgtaatcacagccattgatggggaaaatactagcaatatgacacacttggaagctcagaacagaatcaaaggctgcacagacaacttgactctcactgtagccagatctgaacataaagtctggtctcctctggtgacggaggaagggaagcgtcatccatacaagatgaatttagcctctgaaccccaggaggtcctgcacataggaagcgcccacaaccgaagtgccatgccctttaccgcctcgcctgcctccagcactactgccagggtcatcacaaaccagtacaacaacccagctggcctctactcttctgaaaatatctccaacttcaacaatgccctggagtcaaagactgctgccagcggggtggaggcgaacagcagacccttagaccatgctcagcctccaagcagccttgtcatcgacaaagaatctgaagtttacaagatgcttcaggagaaacaggagttgaatgagcccccgaaacagtccacgtctttcttggttttgcaggaaatcctggagtctgaagaaaaaggggatcccaacaagccctcaggattcagaagtgttaaagctcctgtcactaaagtggctgcgtcgattggaaatgctcagaagttgcctatgtgtgacaaatgtggcactgggattgttggtgtgtttgtgaagctgcgggaccgtcaccgccaccctgagtgttatgtgtgcactgactgtggcaccaacctgaaacagaagggccatttctttgtggaggatcaaatctactgtgagaagcatgcccgggagcgagtcacaccacctgagggttatgaagtggtcactgtgttccccaagtga

SEQ ID NO: 16351 - DNA, 1513 bp, Artificial Sequence
  Synthetic polypeptide
atttctggagaatgaggccacagatgggcattttttaaaagccttctcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtgtggacactgcaagaaacttgcccccgagtatgagaaggccgccaaggagctcagcaagcgttctcctccaattcccctggcaaaggtcgacgccaccgcagaaacagacctggccaagaggtttgatgtctctggctatcccaccctgaaaattttccgcaaaggaaggccttatgactacaacggcccacgagaaaaatatggaatcgttgattacatgatcgagcagtccgggcctccctccaaggagattctgaccctgaagcaggtccaggagttcctgaaggatggagacgatgtcatcatcatcggggtctttaagggggagagtgacccagcctaccagcaataccaggatgccgctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctgcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttga

SEQ ID NO: 16352 - DNA, 206 bp, Artificial Sequence; identical to SEQ ID NO: 10737
  Synthetic polypeptide

SEQ ID NO: 16353 - DNA, 1038 bp, Artificial Sequence; identical to SEQ ID NO: 12062
  Synthetic polypeptide

SEQ ID NO: 16354 - DNA, 410 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagc

SEQ ID NO: 16355 - DNA, 2910 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaa

SEQ ID NO: 16356 - DNA, 2886 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacgggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaa

SEQ ID NO: 16357 - DNA, 433 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggctgggaaacctattgcaggtaaaccgaaccctgggtcggaatgtgcctctagcctcccaactcatcctgatgcctaatgggg

SEQ ID NO: 16358 - DNA, 443 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctc

SEQ ID NO: 16359 - DNA, 450 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcagtccagcaggaggtgccatctgctcagtctcctggagttcatgcagatgcagatcaggttcagaacttggcagtaa

SEQ ID NO: 16360 - DNA, 318 bp, Artificial Sequence
  Synthetic polypeptide
ctgcattgtctaataacgtagtcactagccacatatcgctattgagtgcttgaaatgtggctagtctaaatggagacgtcctataagattttagagttagactacttagtacaaaaaaaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccaccc

SEQ ID NO: 16361 - DNA, 456 bp, Artificial Sequence; identical to SEQ ID NO: 6649
  Synthetic polypeptide

SEQ ID NO: 16362 - DNA, 480 bp, Artificial Sequence; identical to SEQ ID NO: 6650
  Synthetic polypeptide

SEQ ID NO: 16363 - DNA, 186 bp, Artificial Sequence; identical to SEQ ID NO: 6651
  Synthetic polypeptide

SEQ ID NO: 16364 - DNA, 1275 bp, Artificial Sequence
  Synthetic polypeptide
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaccaagtatcaggggatctgtcctcctgttacccgaaacgaaacccactttgatgctggagctaagtttcatgttccaaatgtga

SEQ ID NO: 16365 - DNA, 3768 bp, Artificial Sequence
  Synthetic polypeptide
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccagttccacgaggcactgtgccaggcagctggccacacgggccccctgcacaagtgtgacatctaccagtccaaggaggccgggcagcgcctggcgaccgccatgaagctgggcttcagtaggccgtggccggaagccatgcagctgatcacgggccagcccaacatgagcgcctcggccatgttgagctacttcaagccgctgctggactggctccgcacggagaacgagctgcatggggagaagctgggctggccgcagtacaactggacgccgaactccgctcgctcagaagggcccctcccagacagcggccgcgtcagcttcctgggcctggacctggatgcgcagcaggcccgcgtgggccagtggctgctgctcttcctgggcatcgccctgctggtagccaccctgggcctcagccagcggctcttcagcatccgccaccgcagcctccaccggcactcccacgggccccagttcggctccgaggtggagctgagacactcctga

SEQ ID NO: 16366 - DNA, 3285 bp, Artificial Sequence
  Synthetic polypeptide
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcagcagggctggaacgccacgcacatgttccgggtggcagaggagttcttcacctccctggagctctcccccatgcctcccgagttctgggaagggtcgatgctggagaagccggccgacgggcgggaagtggtgtgccacgcctcggcttgggacttctacaacaggaaagacttcaggatcaagcagtgcacacgggtcacgatggaccagctctccacagtgcaccatgagatgggccatatacagtactacctgcagtacaaggatctgcccgtctccctgcgtcggggggccaaccccggcttccatgaggccattggggacgtgctggcgctctcggtctccactcctgaacatctgcacaaaatcggcctgctggaccgtgtcaccaatgacacggaaagtgacatcaattacttgctaaaaatggcactggaaaaaattgccttcctgccctttggctacttggtggaccagtggcgctggggggtctttagtgggcgtacccccccttcccgctacaacttcgactggtggtatcttcgaaccaagtatcaggggatctgtcctcctgttacccgaaacgaaacccactttgatgctggagctaagtttcatgttccaaatgtgacaccatacatcaggtactttgtgagttttgtcctgcagttccagttccatgaagccctgtgcaaggaggcaggctatgagggcccactgcaccagtgtgacatctaccggtccaccaaggcaggggccaagctccggaaggtgctgcaggctggctcctccaggccctggcaggaggtgctgaaggacatggtcggcttagatgccctggatgcccagccgctgctcaagtacttccagccagtcacccagtggctgcaggagcagaaccagcagaacggcgaggtcctgggctggcccgagtaccagtggcacccgccgttgcctgacaactacccggagggcatagacctggtgactgatgaggctgaggccagcaagtttgtggaggaatatgaccggacatcccaggtggtgtggaacgagtatgccgaggccaactggaactacaacaccaacatcaccacagagaccagcaagattctgctgcagaagaacatgcaaatagccaaccacaccctgaagtacggcacccaggccaggaagtttgatgtgaaccagttgcagaacaccactatcaagcggatcataaagaaggttcaggacctagaacgggcagcactgcctgcccaggagctggaggagtacaacaagatcctgttggatatggaaaccacctacagcgtggccactgtgtgccacccgaatggcagctgcctgcagctcgagccagatctgacgaatgtgatggccacgtcccggaaatatgaagacctgttatgggcatgggagggctggcgagacaaggcggggagagccatcctccagttttacccgaaatacgtggaactcatcaaccaggctgcccggctcaatggctatgtagatgcaggggactcgtggaggtctatgtacgagacaccatccctggagcaagacctggagcggctcttccaggagctgcagccactctacctcaacctgcatgcctacgtgcgccgggccctgcaccgtcactacggggcccagcacatcaacctggaggggcccattcctgctcacctgctggggaacatgtgggcgcagacctggtccaacatctatgacttggtggtgcccttcccttcagccccctcgatggacaccacagaggctatgctaaagcagggctggacgcccaggaggatgtttaaggaggctgatgatttcttcacctccctggggctgctgcccgtgcctcctgagttctggaacaagtcgatgctggagaagccaaccgacgggcgggaggtggtctgccacgcctcggcctgggacttctacaacggcaaggacttccggatcaagcagtgcaccaccgtgaacttggaggacctggtggtggcccaccacgaaatgggccacatccagtatttcatgcagtacaaagacttacctgtggccttgagggagggtgccaaccccggcttccatgaggccattggggacgtgctagccctctcagtgtctacgcccaagcacctgcacagtctcaacctgctgagcagtgagggtggcagcgacgagcatgacatcaactttctgatgaagatggcccttgacaagatcgcctttatccccttcagctacctcgtcgatcagtggcgctggagggtatttgatggaagcatcaccaaggagaactataaccaggagtggtggagcctcaggctgaagtaccagggcctctgccccccagtgcccaggactcaaggtgactttgacccaggggccaagttccacattccttctagcgtgccttacatcaggtactttgtcagcttcatcatccagttccaccccttctcccagcacacggctgcctga

SEQ ID NO: 16367 - DNA, 789 bp, Artificial Sequence
  Synthetic polypeptide
ggctgggcgtggtggctcaagcctgtaatcccagcactttgggaggctgaggtgggcgcatcgcttgagcccaggagttcaagaccagcctggccaacatggcaaaacctcgtctctacaaaaaaaaaatagctgggcttggtggtgcgtgcacctacagtcccagctactcttgaaactgagggggaaggatcacctgagcccaggaggtcaaggctacagtgagctgtgattgcactactgcaccccagcctgcgtgacagatacaacgccctgctaagcaacatgagcaggatctactccaccgccaaggtctgcctccccaacaagactgccacctgctggtccctggacccagatctcaccaacatcctggcttcctcgcgaagctacgccatgctcctgtttgcctgggagggctggcacaacgctgcgggcatcccgctgaaaccgctgtacgaggatttcactgccctcagcaatgaagcctacaagcaggacggcttcacagacacgggggcctactggcgctcctggtacaactcccccaccttcgaggacgatctggaacacctctaccaacagctagagcccctctacctgaacctccatgccttcgtccgccgcgcactgcatcgccgatacggagacagatacatcaacctcaggggacccatccctgctcatctgctgggagacatgtgggcccagagctgggaaaacatctacgacatggtggtgcctttcccagacaagcccaacctcgatgtcaccagtactatgctgcag

SEQ ID NO: 16368 - DNA, 731 bp, Artificial Sequence
  Synthetic polypeptide
tgtcaggcctctgagcccaagccaagccatcgcatcccctgtgacttgcacatatacgcccagatggcctgaagtaactgaagaatcacaaaagaagtgaaaaggccctgccctgccttaactgatgacattccaccattgtgatttgttcctgccccaccttaactgagtgattaaccctgtgaatttccttctcctggctcagaagctgccccaccttaactgagtgattaaccctgcgaatttccttctcctggctcagaagctcccccactgagcaccttgtgacccccgcccctgcccaccagagagcaaccccctttgactgtaattttccattaccttcccaaatcctataaaacggccccacccctatctcccttggctgactctctttgcggactcagcccgcctgcacccagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16369 - DNA, 764 bp, Artificial Sequence
  Synthetic polypeptide
gtgcctgcagaaggggtcctacagtctggtgggtctaagagcttgggttgggcttaagtcccagcccagccactcactggcatggagaggacggaaggtgtttggctagtcacctgacctcactgagcctcagcttcctcatctgagagagagaacctaatgagcaaggcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatag

SEQ ID NO: 16370 - DNA, 1142 bp, Artificial Sequence
  Synthetic polypeptide
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16371 - DNA, 1100 bp, Artificial Sequence
  Synthetic polypeptide
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacagggacttcccggggttaagtgacgattattatggagcaaagaacctgaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16372 - DNA, 1196 bp, Artificial Sequence
  Synthetic polypeptide
ggccgggcgcggtggctcacacctgtaatcccaacacttttggaggccaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctga

SEQ ID NO: 16373 - DNA, 1334 bp, Artificial Sequence; identical to SEQ ID NO: 9457
  Synthetic polypeptide

SEQ ID NO: 16374 - DNA, 701 bp, Artificial Sequence; identical to SEQ ID NO: 9458
  Synthetic polypeptide

SEQ ID NO: 16375 - DNA, 2870 bp, Artificial Sequence; identical to SEQ ID NO: 9459
  Synthetic polypeptide

SEQ ID NO: 16376 - DNA, 2053 bp, Artificial Sequence; identical to SEQ ID NO: 7369
  Synthetic polypeptide

SEQ ID NO: 16377 - DNA, 632 bp, Artificial Sequence
  Synthetic polypeptide
agaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcagggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctacatgaccgatggactttctga

SEQ ID NO: 16378 - DNA, 2281 bp, Artificial Sequence; identical to SEQ ID NO: 15803
  Synthetic polypeptide

SEQ ID NO: 16379 - DNA, 700 bp, Artificial Sequence
  Synthetic polypeptide
ggccaggcacggtggctcacgcctgtaatcccagtactttgggaggccgaggcgggtggatcacctgaggtcaggagttcgagaccagcctggccaacatggcgaaaccccgtctctactaaaaaatacaaaaattagccgtgcgtggcggtcctacatcgccaatcgagtgactgacaagctgacacctattcacgaccgcattttctgctgtcgctcaggctcagctgctgatacccaggcagtagctgatgctgtcacctaccagctcggtttccacagcattgaactgaatgagcctccactggtccacacagcagccagcctctttaaggagatgtgttaccgataccgggaagacctgatggcgggaatcatcatcgcaggctgggaccctcaagaaggagggcaggtgtactcagtgcctatggggggtatgatggtaaggcagtcctttgccattggaggctccgggagctcctacatctatggctatgttgatgctacctaccgggaaggcatgaccaaggaagagtgtctgcaattcactgccaatgctctcgctttggccatggagcgggatggctccagtggaggagtgatccgcctggcagccattgcagagtcaggggtagagcggcaagtacttttgggagaccagatacccaaattcgccgttgccactttaccacccgcctga

SEQ ID NO: 16380 - DNA, 298 bp, Artificial Sequence
  Synthetic polypeptide
ggccaggcacggtggctcacgcctgtaatcccagtactttgggaggccgaggcgggtggatcacctgaggtcaggagttcgagaccagcctggccaacatggcgaaaccccgtctctactaaaaaatacaaaaattagccgtgcgtggcggtcctacatcgccaatcgagtgactgacaagctgacacctattcacgaccgcattttctgctgtcgctcaggctcagctgctgatacccaggcagtagctgatgctgtcacctaccagctcggtttccacagcagccagcctctttaa

SEQ ID NO: 16381 - DNA, 414 bp, Artificial Sequence
  Synthetic polypeptide
ggccaggcgcagtggctcatgcctgtaatcccagcaaggatgtcattgacaaacagttctgcctgtcatcttctctgctgggctggtacccaagagactacagatatcaaaggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 16382 - DNA, 1372 bp, Artificial Sequence
  Synthetic polypeptide
gaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggcggcatctggaggtagcagaagtagcagcagcccactggtggtagtgtctgtgaagtctcccaatcagagtctccgccttggcttgtccagattagcacgagttaaacctttgcatccaaatgccactagcacctga

SEQ ID NO: 16383 - DNA, 1522 bp, Artificial Sequence
  Synthetic polypeptide
gaaaaaggaacccacacgtgggagaaaatatttgtaaatcagataactgataagggactgtatccagagtatacacagaactcgtaaaactcaacagtaaaaagactaacaacacaatttaaaatgtgcaaaagatttcaatagactttctccagagaagataaacaaataaccaataaacacatgaaaagatgctcaatatcattagctgtgagggcaatgcaaatcaaaatcagaatgagataatacttcacacccactagatgacttaatacaaaagacaaggaatgtggagaaatttgaaccctcatatattgctggtgggaaagtaaaatggtgcagctaaattggaaaatggtttagcagttcctcaaaatgttaaacagagttattacatgacccagcctatgtatgtatccaagagaaatgaaaacatatgcccacacaaaaacccatacatgaatgttcacagcaacattattcataatagctaaaaaaaaatggaggcaatctaaatgtctatctgctaatgaatggataagtaaaatgtggtttccacaaaatggaatatttttcagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctga

SEQ ID NO: 16384 - DNA, 2502 bp, Artificial Sequence; identical to SEQ ID NO: 8603
  Synthetic polypeptide

SEQ ID NO: 16385 - DNA, 441 bp, Artificial Sequence; identical to SEQ ID NO: 8604
  Synthetic polypeptide

SEQ ID NO: 16386 - DNA, 2454 bp, Artificial Sequence; identical to SEQ ID NO: 8605
  Synthetic polypeptide

SEQ ID NO: 16387 - DNA, 1736 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaagctggaaaacctcatgctggacaaagatggccacatcaagatcactgactttggcctctgcaaagagggcatcagtgacggggccaccatgaaaaccttctgtgggaccccggagtacctggcgcctgaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtga

SEQ ID NO: 16388 - DNA, 1607 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcggaaggaagtcatcattgccaaggatgaagtcgctcacacagtcaccgagagccgggtcctccagaacaccaggcacccgttcctcactgcgctgaagtatgccttccagacccacgaccgcctgtgctttgtgatggagtatgccaacgggggtgagctgttcttccacctgtcccgggagcgtgtcttcacagaggagcgggcccggttttatggtgcagagattgtctcggctcttgagtacttgcactcgcgggacgtggtataccgcgacatcaaggtgctggaggacaatgactatggccgggccgtggactggtgggggctgggtgtggtcatgtacgagatgatgtgcggccgcctgcccttctacaaccaggaccacgagcgcctcttcgagctcatcctcatggaagagatccgcttcccgcgcacgctcagccccgaggccaagtccctgcttgctgggctgcttaagaaggaccccaagcagaggcttggtggggggcccagcgatgccaaggaggtcatggagcacaggttcttcctcagcatcaactggcaggacgtggtccagaagaagctcctgccacccttcaaacctcaggtcacgtccgaggtcgacacaaggtacttcgatgatgaatttaccgcccagtccatcacaatcacaccccctgaccgctatgacagcctgggcttactggagctggaccagcggacccacttcccccagttctcctactcggccagcatccgcgagtga

SEQ ID NO: 16389 - DNA, 581 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagctga

SEQ ID NO: 16390 - DNA, 842 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactccttggcaagggaacctttggcaaagtcatcctggtgcgggagaaggccactggccgctactacgccatgaagatcctgcgg

SEQ ID NO: 16391 - DNA, 761 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgacttcgactatctcaaactc

SEQ ID NO: 16392 - DNA, 745 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgaggagatggaagtggcggtcagcaaggcacgggctaaagtgaccatgaatgactt

SEQ ID NO: 16393 - DNA, 692 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactgag

SEQ ID NO: 16394 - DNA, 691 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgactga

SEQ ID NO: 16395 - DNA, 688 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcctccacgac

SEQ ID NO: 16396 - DNA, 681 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccatggactacaagtgtggctcccccagtgactcct

SEQ ID NO: 16397 - DNA, 649 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccaggcgaggaccccat

SEQ ID NO: 16398 - DNA, 637 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgccaacagcctcaagcagcgggccccagg

SEQ ID NO: 16399 - DNA, 612 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtggatgcgggccatccagatggtcgcca

SEQ ID NO: 16400 - DNA, 588 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagagggaggagtgga

SEQ ID NO: 16401 - DNA, 580 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagaggga

SEQ ID NO: 16402 - DNA, 577 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagaggccgcgacccaacacctttgtcatacgctgcctgcagtggaccacagtcatcgagaggaccttccacgtggattctccagacgagag

SEQ ID NO: 16403 - DNA, 491 bp, Artificial Sequence
  Synthetic polypeptide
ctccctagctggctccccacctccctggccttccaacctccagcctcaccctctacatggcagccagagggatcattctcagtctgtttgtgtctcttccctatctaaagccttctatggctccctgctgccctgaggacaaagtccagattctttcccatggcctccaaagccctgcctggctggccccagcccacctctccagggctgtctctcacttacccctcctcacccttggagcagaattggccaccccctgaggatgttgaacctcctctcacctctgagcgtctgttctccgtgtaccctctaagttcccttttccttcagggcttagttcagagaagctgcttcctctgggaagccccccaaccccccaggctgggttggatgctacctctgagcttctgcacacctctaggcttgtccccatcgcggccctgtctatggagccatcactctctgaatgccagctgatgaagaccgagagg

SEQ ID NO: 16404 - DNA, 1407 bp, Artificial Sequence; identical to SEQ ID NO: 9548
  Synthetic polypeptide

SEQ ID NO: 16405 - DNA, 3448 bp, Artificial Sequence
  Synthetic polypeptide
caggcatacctcatattattgtgctttattttatcacacctcacagatacagcgttttatacaaattgaaggtttgtggtaatcctgtgttgaacaagtctgttggtgccatttttcaaaaagtatgtgcttacttcatgtttctgtgccacattctggtaattcttccaatatttccaacttattttactgttgctttgctgctattgtaattgttttggcatgccacaaaccattcccatgtaagatggtgaacttaattgataaactttgtgtatgctgtgactgctccaccagtcggccgttctcctgtctctctcccactttcttgggcctccctctttcctgacacacaacaaaattgaaattaggaaaattaataaccctacaatggcctctaagtgttcaagtgaagggaagagtcacatgtgtctcagtttacatcaaaaactagaaatgatgaagcttagtgaggaagacatgtcgaaagctgtggtaggccgaaagttaggcctcttgttccaaatagtcaagctgtgaatgcaaggcacaagttcctgcagtaaactaaaagggctactcaggtaagcacatgaatgataagaaagcaagacaggctttttgctgatatgggaaagtttgagtagtcgagatagaagatcagatcagccacaacattcccttatgccaaaacttaatccagaggaaggccctaacactcttctgagaaggctgagagaggtgaggaagctgcacaagaaaatttggaagctagcagaggttggttcatgaggtttttctttttcttttcttttcttttctttttttttggttcatgaggtttaagggaagaagctgtctccgtaacataaatgtgcaagatgaagcagcaagtgctgatggagaagctgcagcaagttacccagaagatctagctaagatcattggtaagatggctacactcaacaacagattctcaatgtagatgaaaacagccttctcttggaagaagatgccatctaggactttcctagctagagaggaaaagtcagtttctggcttcaaagctttgaagaacaggctgattctcttgttacaggctaatgaaactggtaactttaaagttgaggccagtgcttaccgaccattctgaagattctagggcccttaagaaacatgctaaatctactctgcctgtgctctataaatggaacaataaagtcatgacagcacatctgtttgcactatggctaactgaatgtttaaagcccactgttgagacttactgtacagacaagaagggattcctttcataatattactgctcattaacaatgcacttggtcactcgagctttgatggagatgtacaaggagattaatgatttcatgcctgctgacacaagatcagttttgcagcctatggatcaaggagtaatttttactttcaagtcttattatttaagaaatacatttcataaggctagagctgccattgatagttattcctttgatggatctgggaaaaccttctggaaaggattcattattctagatactgttaagaacatttgtgatgcatgggaggaggtaaaaatattaacatgaataggaatttggaagaagttgattccaaacttcatagatgactttgaggggttctcactgcttcagtggaggaagtaactacacacgtggtggaaatagcaagagaagtaggattaaaagtggagcctgaagatgtgactgaatttgctgcaatctcatgataaaacttgggatgaattgcttcttacagatgaatggtttattgatagaatctactcctggtgcagatgctgtgaacatttttgttgaagacaacaaaggatttagaatttccacataaagttagttgataaagcagaggcagagtttgagaggattgactccaattttgaaagttctcctatgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctag

SEQ ID NO: 16406 - DNA, 3463 bp, Artificial Sequence
  Synthetic polypeptide
caggcatacctcatattattgtgctttattttatcacacctcacagatacagcgttttatacaaattgaaggtttgtggtaatcctgtgttgaacaagtctgttggtgccatttttcaaaaagtatgtgcttacttcatgtttctgtgccacattctggtaattcttccaatatttccaacttattttactgttgctttgctgctattgtaattgttttggcatgccacaaaccattcccatgtaagatggtgaacttaattgataaactttgtgtatgctgtgactgctccaccagtcggccgttctcctgtctctctcccactttcttgggcctccctctttcctgacacacaacaaaattgaaattaggaaaattaataaccctacaatggcctctaagtgttcaagtgaagggaagagtcacatgtgtctcagtttacatcaaaaactagaaatgatgaagcttagtgaggaagacatgtcgaaagctgtggtaggccgaaagttaggcctcttgttccaaatagtcaagctgtgaatgcaaggcacaagttcctgcagtaaactaaaagggctactcaggtaagcacatgaatgataagaaagcaagacaggctttttgctgatatgggaaagtttgagtagtcgagatagaagatcagatcagccacaacattcccttatgccaaaacttaatccagaggaaggccctaacactcttctgagaaggctgagagaggtgaggaagctgcacaagaaaatttggaagctagcagaggttggttcatgaggtttttctttttcttttcttttcttttctttttttttggttcatgaggtttaagggaagaagctgtctccgtaacataaatgtgcaagatgaagcagcaagtgctgatggagaagctgcagcaagttacccagaagatctagctaagatcattggtaagatggctacactcaacaacagattctcaatgtagatgaaaacagccttctcttggaagaagatgccatctaggactttcctagctagagaggaaaagtcagtttctggcttcaaagctttgaagaacaggctgattctcttgttacaggctaatgaaactggtaactttaaagttgaggccagtgcttaccgaccattctgaagattctagggcccttaagaaacatgctaaatctactctgcctgtgctctataaatggaacaataaagtcatgacagcacatctgtttgcactatggctaactgaatgtttaaagcccactgttgagacttactgtacagacaagaagggattcctttcataatattactgctcattaacaatgcacttggtcactcgagctttgatggagatgtacaaggagattaatgatttcatgcctgctgacacaagatcagttttgcagcctatggatcaaggagtaatttttactttcaagtcttattatttaagaaatacatttcataaggctagagctgccattgatagttattcctttgatggatctgggaaaaccttctggaaaggattcattattctagatactgttaagaacatttgtgatgcatgggaggaggtaaaaatattaacatgaataggaatttggaagaagttgattccaaacttcatagatgactttgaggggttctcactgcttcagtggaggaagtaactacacacgtggtggaaatagcaagagaagtaggattaaaagtggagcctgaagatgtgactgaatttgctgcaatctcatgataaaacttgggatgaattgcttcttacagatgaatggtttattgatagaatctactcctggtgcagatgctgtgaacatttttgttgaagacaacaaaggatttagaatttccacataaagttagttgataaagcagaggcagagtttgagaggattgactccaattttgaaagttctcctatgacttccaggactctgaagaaacagttacaagcaggatgcttttcccaacctctgcgcaagaatcttcccgtggcctcccagatgcaaatgacttgtgccttggcctgcagtccctcagtctgacaggctgggaccgaccctggagcacccaggactcagattcctcagcccagagcagcacacactcggtactgagcatgctccataacccactgggaaatgtcctaggaaaaccccccttgagcttcctgcctctggatccccttgggtctgacttggtggacaagtttccagcaccctcagttagaggatcacgcctggacacccggcccatcctggactctcgatctagcagcccctctgactcagacaccagtggcttcagctctggatcagatcatctctcagatttgatttcaagccttcgcatttctccacctctgcccttcctgtctctgtcagggggtggtcccagagaccctttaaagatgggggtagggtctcggatggaccaagagcaagctgctcttgctgcagtcactccctccccaaccagtgcttcaaagagatggccaggagcttctgtgtggccgtcctgggacctcctcgaagctcccaaagaccccttcagcatagagagagaggccaggctgcaccgacaagctgcagctgtgaatgaagccacctgtacctggagtggccagcttcctccccggaactataagaaccccatctactcttgcaaggtgtttctaggaggtgttccttgggatattacagaagctggattagttaacaccttccgtgtttttggctctttgagtgtggagtggcctggtaaggatggcaagcatccccggtgtcctcccaaaggtaatatgcctaaagggtatgtgtatctggtcttcgaactagagaagtctgtccgatccttgcttcaggcttgctctcatgacccgctgagcccagatggcctgagtgaatattatttcaagatgtccagccgaaggatgcgctgcaaggaggtgcaggtgatcccctgggtattagccgacagtaactttgtccggagcccatctcagaggcttgaccccagcaggacggtgtttgtcggtgctctgcatggaatgctaaatgctgaggccctggcagccatcttgaacgacctatttggtggagtggtgtatgccgggattgacacagataagcacaagtatcccattggttctggtcgtgtgactttcaataaccaacggagttacctgaaagcagtcagcgctgcttttgtggagatcaaaaccaccaagttcacaaagaaggttcagattgacccctacctagaagattctctgtgtcatatctgcagttctcagcctggtcctttcttctgtcgagatcaggtctgcttcaaatacttctgccggagctgctggcactggcggcacagcatggagggcctgcgccaccacagccccctgatgcggaaccagaagaaccgagattccagctag

SEQ ID NO: 16407 - DNA, 1482 bp, Artificial Sequence
  Synthetic polypeptide
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttctggagatcctttcacaccgagcggaagacagaaccagccacaggtttcatcgacggtgacttgattgagagtttcctggatattagccgccccaagatgcaggaggtggtggcaaacctacagtatgacgatggcagcggtatgaagcgagaggccactgcagacgacctcatcaaggttgtggaggagctaactcggatccattag

SEQ ID NO: 16408 - DNA, 1338 bp, Artificial Sequence
  Synthetic polypeptide
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaagtgcttcatgcccaccagtttctgcagaatgaatatgccctcagtctggtttcctgcaagctgggcaaagaccccaacacttacttcattgtgggcacagcaatggtgtatcctgaagaggcagagcccaagcagggtcgcattgtggtctttcagtattcggatggaaaactacagactgtggctgaaaaggaagtgaaaggggccgtgtactctatggtggaatttaacgggaagctgttagccagcatcaatagcacggtgcggctctatgagtggacaacagagaaggagctgcgcactgagtgcaaccactacaacaacatcatggccctctacctgaagaccaagggcgacttcatcctggtgggcgaccttatgcgctcagtgctgctgcttgcctacaagcccatggaaggaaactttgaagagattgctcgagactttaatcccaactggatgagtgctgtggaaatcttggatgatgacaattttctgggggctgaaaatgcctttaacttgtttgtgtgtcaaaaggatagcgctgccaccactgacgaggagcggcagcacctccaggaggttggtcttttccacctgggcgagtttgtcaatgtcttttgccacggctctctggtaatgcagaatctgggtgagacttccacccccacacaaggctcggtgctcttcggcacggtcaacggcatgatagggctggtgacctcactgtcagagagctggtacaacctcctgctggacatgcagaatcgactcaataaagtcatcaaaagtgtggggaagatcgagcactccttccacctggagatcctttcacaccgagcggaagacagaaccagccacaggtttcatcgacggtga

SEQ ID NO: 16409 - DNA, 459 bp, Artificial Sequence
  Synthetic polypeptide
tttttaactggttgcacattatcattaaatggaaagctgttaaaaatctcagcctaggctcacccagaccaatgaaataagagtatcttgtggatgggaccaggaatcagaattgtctgtctctccagcctggcgctggccaacaatagcaccctcaccattggcaccatcgatgagatccagaagctgcacattcgcacagttcccctctatgagtctccaaggaagatctgctaccaggaagtgtcccagtgtttcggggtcctctccagccgcattgaagtccaagacacgagtgggggcacgacagccttgaggcccagcgctagcacccaggctctgtccagcagtgtaagctccagcaagctgttctccagcagcactgctcctcatgagacctcctttggagaagaggtggaggtgcacaacctacttatcattgaccaacacacctttgaa

SEQ ID NO: 16410 - DNA, 2334 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16411 - DNA, 2109 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16412 - DNA, 2277 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16413 - DNA, 2280 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccatgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16414 - DNA, 2166 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagtgtcccaaagtttactcaagactacccaggaacctcttgcccgagatcctgttaaacttcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttgatgagctgcttcagaaagagcaaaactattcagatgacgtcttggccaacatgattagtgaaccaaggatcagttacggaaacgatgctctcatgccatctttgaccgaaacgaaaaccaccgtggagctccttcccgtgaatggagagttcagcctggacgatctccagccgtggcattcttttggggctgactctgtgccagccaacacagaaaacgaagttgagcctgttgatgcccgccctgctgccgaccgaggactgaccactcgaccaggttctgggttgacaaatatcaagacggaggagatctctgaagtgaagatggatgcagaattccgacatgactcaggatatgaagttcatcatcaaaaattggtgttctttgcagaagatgtgggttcaaacaaaggtgcaatcattggactcatggtgggcggtgttgtcatagcgacagtgatcgtcatcaccttggtgatgctgaagaagaaacagtacacatccattcatcatggtgtggtggaggttgacgccgctgtcaccccagaggagcgccacctgtccaagatgcagcagaacggctacgaaaatccaacctacaagttctttgagcagatgcagaactag

SEQ ID NO: 16415 - DNA, 1713 bp, Artificial Sequence
  Synthetic polypeptide
tgtcaggcctctgagcccaagctaaaccatcccctgtgacctgcacgtattcgcccagatggcccgaagcaagtgaagaatcacaaaagaagtgaaaatggcctgttcctgccttaactgatgacattccaccacaaaagaagtgaaaatggccggtccttgccttaagtgatgacattatcttgtgaaattccttcttctggctcatcctggctcaaaaactcccccactgagcaccctgtgacccccacccctgccccccagagaacaaccccctttgactgcaattttcctttacctacccgaatcttacaaaatggccctaccccatctccctttcctgactctttttcggactcagcctgcctgcacccagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagccgatgatgacgaggacgatgaggatggtgatgaggtagaggaagaggctgaggaaccctacgaagaagccacagagagaaccaccagcattgccaccaccaccaccaccaccacagagtctgtggaagaggtggttcgagaggtgtgctctgaacaagccgagacggggccgtgccgagcaatgatctcccgctggtactttgatgtgactgaagggaagtgtgccccattcttttacggcggatgtggcggcaaccggaacaactttgacacagaagagtactgcatggccgtgtgtggcagcgccattcctacaacagcagccagtacccctgatgccgttgacaagtatctcgagacacctggggatgagaatgaacatgcccatttccagaaagccaaagagaggcttgaggccaagcaccgagagagaatgtcccaggtcatgagagaatgggaagaggcagaacgtcaagcaaagaacttgcctaaagctgataagaaggcagttatccagcatttccaggagaaagtggaatctttggaacaggaagcagccaacgagagacagcagctggtggagacacacatggccagagtggaagccatgctcaatgaccgccgccgcctggccctggagaactacatcaccgctctgcaggctgttcctcctcggcctcgtcacgtgttcaatatgctaaagaagtatgtccgcgcagaacagaaggacagacagcacaccctaaagcatttcgagcatgtgcgcatggtggatcccaagaaagccgctcagatccggtcccaggttatgacacacctccgtgtgatttatgagcgcatgaatcagtctctctccctgctctacaacgtgcctgcagtggccgaggagattcaggatgaagttggtgcagtggctcatgcctgtaattccagcattttgggaggccaaggtgggcagatgacttga

SEQ ID NO: 16416 - DNA, 1571 bp, Artificial Sequence; identical to SEQ ID NO: 6810
  Synthetic polypeptide

SEQ ID NO: 16417 - DNA, 2059 bp, Artificial Sequence
  Synthetic polypeptide
tctccctctccctctccccatggtctccctctccctctccccacggtctccctctccctctctttccacggtctccctctcatgctgagccgaagctggactgtactgctgccatctcggctcactgcaacctccctgcctgattctcctgactcagcctgccgagtacctgcgattgcaggctggcgccgccacgcctgactggttttggtggagaccgggtttcgctatgttggccaggccggtctccaacccctaactgcaagtgatccgccagcctcggcctcccgaggtgcggggattgcagacggagtctcgttcactcagtgctcaatggtgcccaggctggagtgcagtggcgtgatctcggctcgctacaacctccacctcccagccgcctgccttggcctcccaaagtgccgagattgcagaaagattgcagcctctgcccggccaccaccccgtctgggaagtgaggagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggccgcccatcgtctgagatgtggggagcgcctctgccctgccgccccgtctgggatgtgaggagcacctctgcccggccgcgaccctgtctgggaggttcattaaaaacctggcctgctcggggatttgtgccagcctggtctgtgtgcccttcgacatcatcctcagcaccagtcctcactgttgctggtggatctacaccatgctcttctgcaaggtcgtcaaatttttgcacaaagtattctgctctgtgaccatcctcagcttccctgctattgctttggacaggtactactcagtcctctatccactggagaggaaaatatctgatgccaagtcccgtgaactggtgatgtacatctgggcccatgcagtggtggccagtgtccctgtgtttgcagtaaccaatgtggctgacatctatgccacgtccacctgcacggaagtctggagcaactccttgggccacctggtgtacgttctggtgtataacatcaccacggtcattgtgcctgtggtggtggtgttcctcttcttgatactgatccgacgggccctgagtgccagccagaagaagaaggtcatcatagcagcgctccggaccccacagaacaccatctctattccctatgcctcccagcgggaggccgagctgcacgccaccctgctctccatggtgatggtcttcatcttgtgtagcgtgccctatgccaccctggtcgtctaccagactgtgctcaatgtccctgacacttccgtcttcttgctgctcactgctgtttggctgcccaaagtctccctgctggcaaaccctgttctctttcttactgtgaacaaatctgtccgcaagtgcttgatagggaccctggtgcaactacaccaccggtacagtcgccgtaatgtggtcagtacagggagtggcatggctgaggccagcctggaacccagcatacgctcgggtagccagctcctggagatgttccacattgggcagcagcagatctttaagcccacagaggatgaggaagagagtgaggccaagtacattggctcagctgacttccaggccaaggagatatttagcacctgcctggagggagagcaggggccacagtttgcgccctctgccccacccctgagcacagtggactctgtatcccaggtggcaccggcagcccctgtggaacctgaaacattccctgataagtattccctgcagtttggctttgggccttttgagttgcctcctcagtggctctcagagacccgaaacagcaagaagcggctgcttccccccttgggcaacaccccagaagagctgatccagacaaaggtgcccaaggtaggcagggtggagcggaagatgagcagaaacaataaagtgagcatttttccaaaggtggattcctag

SEQ ID NO: 16418 - DNA, 639 bp, Artificial Sequence
  Synthetic polypeptide
ggccagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatga

SEQ ID NO: 16419 - DNA, 816 bp, Artificial Sequence
  Synthetic polypeptide
ggccagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacaaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtga

SEQ ID NO: 16420 - DNA, 1458 bp, Artificial Sequence; identical to SEQ ID NO: 9425
  Synthetic polypeptide

SEQ ID NO: 16421 - DNA, 2390 bp, Artificial Sequence
  Synthetic polypeptide
tcaccaaaatgtaacaggttatttctaggtggcggaattgaagtgggaagttggtgtctccaaagtggaagaatttcaagggcctgaagctacagtggagagacaagatccggctcaataatgccatctggcgggcctggtacatgcagtatctggagaagcgcaagaatcctgtgtgccactttgtgacacccctggacggctctgtggacgtagacgagcaccgccggccggaggccatcaccacggaagggaagtactggaagagccgcatcgagattgtgatccgggagtatcacaagtggagaacctacttcaagaaaaggctacagcagcacaaggatgaggacctctccagcctggtccaggacgatgacatgctgtattggcacaagcacggggatggatggaagacccccgtccccatggaggaggatcccctgctggacacagacatgctcatgtcggaattcagcgacaccctcttctccacactttcttcacaccagccggtggcctggcccaatccccgggaaatagcacatctgggaaatgcagacatgatccagccgggactgattcctttgcagcctaacctggacttcatggacacctttgagcctttccaggacctcttctcttctagccgctccatttttggctccatgctacctgcatctgcctcagcacctgtaccagatcccaacaacccacctgcacaggagagcatcctgccgaccacagccctccccactgtgagccttcctgacagcctcatcgcgccccctaccgccccatccctggctcacatggatgagcagggctgtgaacacacctcccggactgaggacccgtttatccagcccacggacttcggtccctcagagccgccactgagtgtcccgcagcccttcctccctgtcttcaccatgcccctgctgtctcccagccccgccccaccgcccatctcccccgtgttaccattagttcctcctcctgccactgccctgaaccccccggctccacccaccttccatcagccacagaagtttgctggagtcaacaaagcgccgtctgtcatcacccacacggcctctgccaccctcacccacgatgcccccgccaccacctttagccagagtcagggccttgtgatcaccacccatcaccctgccccgtcagcggccccttgtgggctggcactgtctcctgtcacccggcctccccagccacggttaacttttgtgcaccccaaacctgtatccttgactgggggcaggcctaagcagccccacaaaatagtgcctgctcccaaaccagagcccgtgtccttggtgttgaagaatgcccgtatcgccccagctgccttttcaggccaaccacaagcggtgatcatgacgtcagggcctctgaagagagaagggatgttggcctccaccgtgtcccagtccaacgtggtcattgcgcctgctgccatcgccagggctcctggggtcccggagttccacagcagcatcctggtgacagatctcggccatggcacgagcagcccgcctgcccccgtctcccggctcttcccaagcacagcgcaagaccccctggggaagggcgagcaggtcccgctgcatgggggcagcccccaggtcactgtcacagggcccagtcgggactgcccaaactcagggcaggcctctccgtgtgcatcggagcagagccccagtcctcaatctccccagaacaactgctcagggaaatccgaccccaaaaatgtggctgcactaaagaaccggcagatgaagcacatctcagctgagcagaaaaggcgcttcaacatcaagatgtgcttcgacatgctcaacagcctcatctccaacaattccaagctgaccagtcacgccatcacactgcagaagactgtggagtacatcaccaagctgcagcaggagagaggccagatgcaggaggaggcccggcggctgcgggaggagatcgaggagctcaatgccaccatcatctcctgccagcagctgctccctgccacgggagtccccgttacccggcgccagtttgatcacatgaaagacatgtttgacgaatacgtgaaaacccggaccttgcagaattggaagttctggattttcagcatcatcatcaagccgctgtttgagtcgttcaagggcatggtgtccaccagcagcctggaggagctgcaccggacggcgctctcctggctggaccagcactgctccctgcccatcctcaggccgatggtattgagcacgctgcggcagctgagcacctccacctccatcctcacagacccggcacagctgccagagcaggcgtccaaggctgtcaccaggattggcaagagattgggagagtcctag

SEQ ID NO: 16422 - DNA, 370 bp, Artificial Sequence; identical to SEQ ID NO: 6522
  Synthetic polypeptide

SEQ ID NO: 16423 - DNA, 1054 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggtatgttgctcttattatttataa

SEQ ID NO: 16424 - DNA, 1120 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggattcccagcctgcagcaacatgctggtcaccatagagacctgagaagcaccctcatctcattggtatcatatttacaaaccaccccttaa

SEQ ID NO: 16425 - DNA, 1189 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattatggtcgaaggaagaaaataa

SEQ ID NO: 16426 - DNA, 1048 bp, Artificial Sequence
  Synthetic polypeptide
ggtctccctctgatgccgagccaaggctggacggtgctgctgccatctcggctcactgcagcctccctgcctgattctcctgcctcagcctgctgagtgcctgcgattgcaggcgcacgccgccacgcctgactggttttcgttttttttttggtggagacggggttttgctgtgttggccgggctggtctccagctcctagccgcgagtgatccgccagcctcggcctcccggggtgccgggattgcggacggagtctcgttcactcagtgctcagtggtgcccaggctggagtgcagtggcgtgatctcggctcgctacagcctccacctcccagccgcctgccttggccccccaaagtgccgagattgcagcctctgcccagccgccaccccgtctgggaagtgaggagcgtctctgcttggccacccatcgtctgggatatgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctggccgcaaccctgtctgggaggtgaagagcgtctctgcccggccgccccgtctgagaagtgaggaaaccctctgcctggcaaccgccccgtctgagaagtgaggagcccctccgtctggcagccaccccgtctgggaagtgaggagcgtctccgcccggcagccaccccgtccgggagggagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaaggggccttcagactccgatga

SEQ ID NO: 16427 - DNA, 500 bp, Artificial Sequence
  Synthetic polypeptide
ggccgggcacagtggctcacacctgtaatcccagccctttgggaggccaaggagtgcggatcacctgaggtcaggagttcgagaccagcccgaccaacatgctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatga

SEQ ID NO: 16428 - DNA, 576 bp, Artificial Sequence; identical to SEQ ID NO: 9577
  Synthetic polypeptide

SEQ ID NO: 16429 - DNA, 570 bp, Artificial Sequence; identical to SEQ ID NO: 9578
  Synthetic polypeptide

SEQ ID NO: 16430 - DNA, 573 bp, Artificial Sequence; identical to SEQ ID NO: 9579
  Synthetic polypeptide

SEQ ID NO: 16431 - DNA, 738 bp, Artificial Sequence; identical to SEQ ID NO: 7971
  Synthetic polypeptide

SEQ ID NO: 16432 - DNA, 816 bp, Artificial Sequence; identical to SEQ ID NO: 7972
  Synthetic polypeptide

SEQ ID NO: 16433 - DNA, 750 bp, Artificial Sequence; identical to SEQ ID NO: 7973
  Synthetic polypeptide

SEQ ID NO: 16434 - DNA, 783 bp, Artificial Sequence; identical to SEQ ID NO: 7974
  Synthetic polypeptide

SEQ ID NO: 16435 - DNA, 711 bp, Artificial Sequence; identical to SEQ ID NO: 7377
  Synthetic polypeptide

SEQ ID NO: 16436 - DNA, 2513 bp, Artificial Sequence; identical to SEQ ID NO: 9639
  Synthetic polypeptide

SEQ ID NO: 16437 - DNA, 804 bp, Artificial Sequence
  Synthetic polypeptide
gtggaatgacaggatggaggaagctttggtgcctgacatcagagtcgccataccagcctggagacaaataccgtggtccagacttataatgctggacgtcctgtctggagctgttgctggtgtcttgatgaggctaactacatctatgctggactggccaatggttcaattctggtatatgacgtgcgaaacacgagcagtcatgtgcaggagttagtagctcagaaagccagatgcccactggtctccctgtcatacatgcccagagctgcctcagctgcatttccatatggtggggtgctggctggaaccttggaggatgcttcattctgggaacagaaaatggacttttctcattggcctcatgtgctgcccttggagccagggggctgcatagactttcagacagagaacagctcccggcactgtcttgtgacctacaggcctgataaaaatcacaccaccatacgaagtgtgctgatggaaatgtcctaccgactggatgacactggaaatccaatctgctcctgccagcctgtacatacattttttggaggacctacttgcaaactattgaccaaaaatgccattttccaaagcccagagaatgatggcaacatcctggtgtgtactggggatgaagcagcaaattctgccctgctgtgggatgctgccagtggctcgttgctccaggacctacagaccgatcagcctgtgttggacatctgcccatttgaggtgaaccgtaacagctacttggctaccttaacagagaagatggtccacatctataagtgggagtga

SEQ ID NO: 16438 - DNA, 1007 bp, Artificial Sequence; identical to SEQ ID NO: 7489
  Synthetic polypeptide

SEQ ID NO: 16439 - DNA, 140 bp, Artificial Sequence
  Synthetic polypeptide
ggccaggtctcaacaaatggcagctattacatcagacagtgacgagtcctgctgctcccttacagtgtctgacagaccactgtggattcagactgggagcattgaagttaacagtgaaacgggcagcacaaagacattag

SEQ ID NO: 16440 - DNA, 981 bp, Artificial Sequence; identical to SEQ ID NO: 12548
  Synthetic polypeptide

SEQ ID NO: 16441 - DNA, 1505 bp, Artificial Sequence; identical to SEQ ID NO: 9488
  Synthetic polypeptide

SEQ ID NO: 16442 - DNA, 2622 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtga

SEQ ID NO: 16443 - DNA, 1218 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttggaggagttctctggccacaccgttggtacagcagctccttccaggctcattcatggaacaggcatggtggcagtcttggagaagagtgccagccccggtcagagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatga

SEQ ID NO: 16444 - DNA, 1125 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggtgaggagcgtctctgcctggccgccccatcagagaagtgaggagaccctccgcctggcaactgccccgtctgagaagtgaggagcccctccgcccggcagccgccccgtctgggaagttgatctcctatcaagagtttttggcatttgaatctgttttatgtgctccagattccatgttcatagtggctttccagttgtttgacaagagtggaaatggagaggtgacatttggattttggatctggggtaaaggaggagttctctggccacaccgttggtacagcagctccttccaggctcattcatggaacaggcatggtggcagtcttggagaagagtgccagccccggtcagagggaagaaatgaatcctgcattccatttcaaagaaaagatgagaatcccatctccccagtgacatccaatgccttcttccaactttgctga

SEQ ID NO: 16445 - DNA, 2234 bp, Artificial Sequence
  Synthetic polypeptide
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaa

SEQ ID NO: 16446 - DNA, 2348 bp, Artificial Sequence
  Synthetic polypeptide
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaa

SEQ ID NO: 16447 - DNA, 917 bp, Artificial Sequence
  Synthetic polypeptide
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccaataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatga

SEQ ID NO: 16448 - DNA, 2039 bp, Artificial Sequence
  Synthetic polypeptide
tcctcatggcctagcacacagctctaggtctatggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttaggtctaaaatgactccaggtgtcgaagatccctga

SEQ ID NO: 16449 - DNA, 1752 bp, Artificial Sequence
  Synthetic polypeptide
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatag

SEQ ID NO: 16450 - DNA, 1689 bp, Artificial Sequence
  Synthetic polypeptide
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagcaagagaaaaagacttattccgcagcgtaaaggacacagatttatcaagaaacattcctggcaaagtgaaagtgtctgcacccaatcttctgaatgtaaaaaggaaatag

SEQ ID NO: 16451 - DNA, 1643 bp, Artificial Sequence
  Synthetic polypeptide
gccgggcgcagtggctcacgcctgtaatcccagcactttgggaggccgaggagggcggatcacgaggtcaagagatcgagaccatcctggctaacacggtttgagaaatttctgtggttcattagctcagagaactatctaattataggtggacgagatcagcaacagaatgaaataattgtgaaaagatacttgacaccaggagacatttatgtacatgctgatcttcatggagctactagctgtgtaattaagaatccaacaggagaacccatccccccacggaccttgactgaagctggcacaatggcactttgctacagtgctgcttgggatgcacgagttatcactagtgcttggtgggtgtaccatcatcaggtatctaaaacagcaccaactggagaatatttgacaacaggaagcttcatgataagaggaaaaaagaattttcttcctccctcatatctaatgatggggtttagcttcctttttaaggtagatgagtcttgtgtttggagacatcagggtgaacgaaaagtcagagtacaggatgaagacatggagacactggcaagttgtacaagtgaactcatatcagaagaaatggaacaattagatggaggtgacacgagcagtgatgaggataaagaagaacatgaaactcctgtggaagtagaactcatgactcaggttgaccaagaggatatcactcttcagagtggcagagatgaactaaatgaggagctcattcaggaagaaagctctgaagacgaaggagaatatgaagaggttagaaaagatcaggattctgttggtgaaatgaaggatgaaggggaagagacattaaattatcctgatactaccattgacttgtctcaccttcaaccccaaaggtccatccagaaattggcttcaaaagaggaatcttctaattctagtgacagtaaatcacagagccggagacatttgtcagccaaggaaagaagggaaatgaaaaagaaaaaacttccaagtgactcaggagatttagaagcgttagagggaaaggataaagaaaaagaaagtactgtacacattgaaactcatcagaacacaagcaaaaatgttgcggctgtgcagccaatgaaacgaggacaaaagagtaaaatgaaaaaaatgaaagaaaaatacaaagaccaggatgaagaagaccgtgaacttatcatgaagttgctggggtctgcaggttcaaacaaagaagaaaaagggaagaaggggaagaaaggaaaaacaaaggacgaacctgtgaagaaacagccccagaaacctagaggtggacagagggtctctgacaacattaagaaagaaactccgttccttgaggttataactcatgagttacaagactttgctgtagatgatccacatgatgacaaggaagagcaagatctggatcaacagggaaatgaggaaaacctatttgattctttgacaggccagccacatcctgaagatgtactactgtttgccattccaatatgtgccccttacaccaccatgacaaactacaaatataaagtgaaacttactcctggagtgcagaaaaagggaaaagctgcaaaaacagccttgaatagtttcatgcattccaaagaagcaacagc

SEQ ID NO: 16452 - DNA, 11880 bp, Artificial Sequence
  Synthetic polypeptide
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 16453 - DNA, 1125 bp, Artificial Sequence
  Synthetic polypeptide
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgac

SEQ ID NO: 16454 - DNA, 945 bp, Artificial Sequence
  Synthetic polypeptide
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaaggaataccagaaacacatggaaacttttgac

SEQ ID NO: 16455 - DNA, 3165 bp, Artificial Sequence
  Synthetic polypeptide
tggttttaataccagctgtaaaatgtaacaggtggtcttaaatgcaggtttctgattaataactctggagattgtgacgttagaatagaaggaaaactttcaaatagaagagtgaatggtgtttggttttctttggactgtatttgtataaatatgttattagtgtgtgttccaaaaattatgggaaacttctataattctgatatgatttcactattaataattataattgttatgtaaaattgttgtgtgccacggaagtaaccaaaattcctagtcaattgtagctttaataatggctgtagacttttgtcatccacagacattttatcttgctttggtccttttcaaaaggcagtttataatcggatataatactctgagtgcaggtcttagataactttaaaaattatgctcttggaatagagggaaaaaacatctaaatgtggcaaactgatgtgttaaacattgctaatccttttgttttcagagtcaacataacttatttctttagagctatttgccacttttaccgagtgagtaaaatacactcagtgacaaattttggagcaaatttgtttctctctacctgatttctctagaatttggaaaccatttgtgagtattctcaatttatgacagtatagttaattgcatacgtgcaataagaatctgttttcttttgtaacaggacaccattggagaaattggtcattttaccaaggctttgactggaatggcatgcttcctttaaagaatcaaagttgacttatagagccatttaaagcccgttggggaatctggcctcataccttgtccacacagagtccctgtacaaggttcctgacctgtgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgtaggttatgcattaatttttatatctgtactcattttgtgctgcttgtaa

SEQ ID NO: 16456 - DNA, 1498 bp, Artificial Sequence; identical to SEQ ID NO: 8305
  Synthetic polypeptide

SEQ ID NO: 16457 - DNA, 1195 bp, Artificial Sequence; identical to SEQ ID NO: 8306
  Synthetic polypeptide

SEQ ID NO: 16458 - DNA, 1462 bp, Artificial Sequence; identical to SEQ ID NO: 8307
  Synthetic polypeptide

SEQ ID NO: 16459 - DNA, 1489 bp, Artificial Sequence; identical to SEQ ID NO: 8308
  Synthetic polypeptide

SEQ ID NO: 16460 - DNA, 1180 bp, Artificial Sequence; identical to SEQ ID NO: 8309
  Synthetic polypeptide

SEQ ID NO: 16461 - DNA, 1808 bp, Artificial Sequence; identical to SEQ ID NO: 8393
  Synthetic polypeptide

SEQ ID NO: 16462 - DNA, 1593 bp, Artificial Sequence
  Synthetic polypeptide
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatag

SEQ ID NO: 16463 - DNA, 243 bp, Artificial Sequence
  Synthetic polypeptide
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctgctgtga

SEQ ID NO: 16464 - DNA, 429 bp, Artificial Sequence
  Synthetic polypeptide
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacggaagaagatcaagctgagtgggctggccctggaccacaaggtgacaggtga

SEQ ID NO: 16465 - DNA, 691 bp, Artificial Sequence
  Synthetic polypeptide
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgaga

SEQ ID NO: 16466 - DNA, 245 bp, Artificial Sequence
  Synthetic polypeptide
gcttggaaggaagtttagcttggatttgaatcccagcttccatcacttttatcagttggtgacttcgctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcag

SEQ ID NO: 16467 - DNA, 1073 bp, Artificial Sequence
  Synthetic polypeptide
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatga

SEQ ID NO: 16468 - DNA, 2375 bp, Artificial Sequence
  Synthetic polypeptide
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcacgggacccgctgtgctggggaggtggccgcgatggccaacaatggcttctgtggtgtgggggtcgctttcaacgcccgaatcggaggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactgaaggctacaacaactgggtcttcatgtccacccacttctgggatgagaacccacagggcgtgtggaccctgggcctagagaacaagggctactatttcaacacggggacgttgtaccgctacacgctgctgctctatgggacggccgaggacatgacagcgcggcctacaggcccccaggtgaccagcagcgcgtgtgtgcagcgggacacagaggggctgtgccaggcgtgtgacggccccgcctacatcctgggacagctctgcctggcctactgccccccgcggttcttcaaccacacaaggctggtgaccgctgggcctgggcacacggcggcgcccgcgctgagggtctgctccagctgccatgcctcctgctacacctgccgcggcggctccccgagggactgcacctcctgtcccccatcctccacgctggaccagcagcagggctcctgcatgggacccaccacccccgacagccgcccccggcttagagctgccgcctgtccccaccaccgctgcccagcctcggccatggtgctgagcctcctggccgtgaccctcggaggccccgtcctctgcggcatgtccatggacctcccactatacgcctggctctcccgtgccagggccacccccaccaaaccccaggtctggctgccagctggaacctga

SEQ ID NO: 16469 - DNA, 1685 bp, Artificial Sequence
  Synthetic polypeptide
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggggtcccgaggacgacggccgcacggtggacggccccggcatcctcacccgcgaggccttccggcgtggtgtgaccaaggtgagtggcagcccgaggagggcaggggtggcaggccaggccgacgccccctccccgcccctcctggtttcccagggccgcggcgggctgggcacgctcttcatctgggcctcgggcaacggcggcctgcactacgacaactgcaactgcgacggctacaccaacagcatccacacgctttccgtgggcagcaccacccagcagggccgcgtgccctggtacagcgaagcctgcgcctccaccctcaccaccacctacagcagcggcgtggccaccgacccccagatcgtcaccacggacctgcatcacgggtgcacagaccagcacacgggcacctcggcctcagccccactggcggccggcatgatcgccctagcgctggaggccaacccgttcctgacgtggagagacatgcagcacctggtggtccgcgcgtccaagccggcgcacctgcaggccgaggactggaggaccaacggcgtggggcgccaagtgagccatcactacggatacgggctgctggacgccgggctgctggtggacaccgcccgcacctggctgcccacccagccgcagaggaagtgcgccgtccgggtccagagccgccccacccccatcctgccgctgatctacatcagggaaaacgtatcggcctgcgccggcctccacaactccatccgctcgctggagcacgtgcaggcgcagctgacgctgtcctacagccggcgcggagacctggagatctcgctcaccagccccatgggcacgcgctccacactcgtggccatacgacccttggacgtcagcactga

SEQ ID NO: 16470 - DNA, 796 bp, Artificial Sequence
  Synthetic polypeptide
gtgccgggattgcagacggagtctggttcactcagtgctcaatggtgcccaggctggagttcagtggcgtgatctcggctcactacaacctccacctcccagccgcctgccttggcctcccaaagtgccaagattgcagcctctgcccggccgccaccccgtctgggaagtgaggagcatctctgcctggccgcccatcgtctgggacatgaggagcccctctgcctggctacccagtctggaaagtgaggagcgtctctgcccggccgccatcccatctaggaagtgaggagcgtctctgcctggccgcccatcgtctaagatgtggggagcgcctctgccccgccgccccgtctgggatgtgaggagcgcctctgcccggccgcgaccccgtctgggaggtgcagtggttccagcagcagacgctgcagcggcgggtgaaacgctctgtcgtggtgcccacggacccctggttctccaagcagtggtacatgaacagcgaggcccaaccagacctgagcatcctgcaggcctggagtcaggggctgtcaggccagggcatcgtggtctctgtgctggacgatggcatcgagaaggaccacccggacctctgggccaactacgaccccctggccagctatgacttcaatgactacgacccggacccccagccccgctacacccccagcaaagagaaccggcgtacggatgctggacggtaccatcaccgatgtcatcgaggcccagtcgctgagcctgcagccgcagcacatccacatttacagcgccagctggg

SEQ ID NO: 16471 - DNA, 1585 bp, Artificial Sequence; identical to SEQ ID NO: 9497
  Synthetic polypeptide

SEQ ID NO: 16472 - DNA, 70 bp, Artificial Sequence
  Synthetic polypeptide
ggcagggcacggtggctcatgcctgtaatcccaggactttgggaggccgagcaaacttcaaggcttttga

SEQ ID NO: 16473 - DNA, 2165 bp, Artificial Sequence; identical to SEQ ID NO: 9527
  Synthetic polypeptide

SEQ ID NO: 16474 - DNA, 1967 bp, Artificial Sequence; identical to SEQ ID NO: 7428
  Synthetic polypeptide

SEQ ID NO: 16475 - DNA, 1142 bp, Artificial Sequence; identical to SEQ ID NO: 7429
  Synthetic polypeptide

SEQ ID NO: 16476 - DNA, 377 bp, Artificial Sequence
  Synthetic polypeptide
gctgggcacggtggctggcgcctgtaatcccagcactttgggaggccgagacgggtggatcacctgagatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagctctatgaaattgcacgcaatgcatacaggaacaaagagagggtcaagatggttatctttcctcctggcttccaacacaacctgctttgtaaaagccccacactgttaataaccgtgagagatttcctgagcaagcagtggtcatga

SEQ ID NO: 16477 - DNA, 399 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaag

SEQ ID NO: 16478 - DNA, 532 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatga

SEQ ID NO: 16479 - DNA, 433 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaaggtctcgctctctctcacaggctggagtgcagtga

SEQ ID NO: 16480 - DNA, 490 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatga

SEQ ID NO: 16481 - DNA, 286 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgcaagaataa

SEQ ID NO: 16482 - DNA, 232 bp, Artificial Sequence
  Synthetic polypeptide
tctatgggcctccatttccccaagtggtctgtaagttgtggaggccagcatggatgacccctgaagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctga

SEQ ID NO: 16483 - DNA, 1261 bp, Artificial Sequence
  Synthetic polypeptide
ggccaggcatggtggctcacgcctgtaatcccaggactttgggaggctgaggcaggtggatcacctgaggtcaggagttcgagaccagcctgaccaacatggtgaaaccccgtctctacaaaagtacaaaaattagcccggcatgatggcgggtacctgtaatcccagctactcgggaggctgaggcagaagaatcacttgaacctgggaggcagaggttgcagttagccgggattgtgccattgcactctagcctagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaa

SEQ ID NO: 16484 - DNA, 2940 bp, Artificial Sequence
  Synthetic polypeptide
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgggaaggctgggaatctag

SEQ ID NO: 16485 - DNA, 1620 bp, Artificial Sequence
  Synthetic polypeptide
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagattataa

SEQ ID NO: 16486 - DNA, 954 bp, Artificial Sequence
  Synthetic polypeptide
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgaggtacattcatatttacagtga

SEQ ID NO: 16487 - DNA, 3642 bp, Artificial Sequence
  Synthetic polypeptide
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgatttgtaagtgctggcagatgccacttggggacctgccaagtgaattccttgtcctcacctcatgtttcccaagcccagcaggaaacatacttgggcttttggattaattctaaaaaaagccaatgcaacattttccttagtggaacctattga

SEQ ID NO: 16488 - DNA, 3669 bp, Artificial Sequence
  Synthetic polypeptide
cacggtctccctctcatgcggagcggaagctggactgtactgctgccatctccgctcactgcaacctccctgcctgattctcctgcctcagtctgccgaatgcctgcgattgcaggcacgcgccgccacgcctgactggttttggtggagacggggtttcgctgtgttggccgggccggtctccagcccctaaccgcgagtgatccgccagcctcggcctcccgaggtgccgggattgcagacggagtctcgttcactcagtgctcaatggtgcccaggctggagtgcagtggcgtgatctcggctcactataacctcccagccgcctgccttggcctcccaaagtgccgagattgcagcctctgcccagccgccaacccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtttctgcccagccgccccgtctgagaagtgaggataccctctgcctggcaaccaccccgtctgagaagtgaggagcccatccgcccggcagctgccccgtctgagaagtgaggagcctctccgcccggcagccaccccatctgggaaatattgtactccaagatacttggattacgaagatttggagcgcaagtactggaagaacttaacttttgtggcacctatctatggtgcagatattaatgggagcatatatgatgagggtgtggatgaatggaacatagctcgcctcaatacagtcttggatgtggttgaagaagagtgtggcatttctattgagggtgtaaataccccatatctctattttggcatgtggaagaccacgtttgcatggcacaccgaagacatggacctctatagcattaattatctccactttggagagcccaagtcttggtatgctatacctccggagcatggaaaacgacttgaaagactagctcaaggttttttcccaagcagctcccaagggtgtgatgcatttcttcgccacaagatgacattgatttctccatcagtattgaagaaatatggtattccctttgacaagataacccaggaggctggagaattcatgatcactttcccatatggctaccatgctggttttaatcatggtttcaactgtgcagaatctacaaattttgctactgtcagatggattgactatggaaaagttgccaaattgtgcacttgcaggaaagacatggtgaagatttcaatggatatctttgtgaggaaatttcagccagacagatatcagctttggaaacaaggaaaggatatatacaccattgatcacacgaagcctactccagcatccacccctgaagtaaaagcatggctgcagaggaggaggaaagtaagaaaagcatcccgaagcttccagtgtgctaggtctacctctaaaaggcctaaggctgatgaggaagaggaagtgtcagatgaagtcgatggggcagaggtccctaaccccgactcagtcacagatgacctcaaggtcagtgaaaagtcagaagcagcagtgaagctgaggaacacagaagcatcttcagaagaagagtcatctgctagcaggatgcaggtggagcagaatttatcagatcatatcaaactctcaggaaacagctgcttaagtacatctgtaacagaagacataaaaactgaggatgacaaagcttatgcatatagaagtgtaccttctatatccagtgaggctgatgattccattccattgtctagtggctatgagaagcccgagaaatcagacccatccgagctttcatggccaaagtcacctgagtcatgctcatcagtggcagagagtaatggtgtgttaacagagggagaagagagtgatgtggagagccatgggaatggccttgaacctggggaaatcccagcggtccccagtggagagagaaatagcttcaaagtccccagtatagcagagggagagaacaaaacctctaagagttggcgccatccacttagcaggcctccagcaagatctccgatgactcttgtgaagcagcaggcgccaagtgatgaagaattgcctgaggttctgtccattgaggaggaagtggaagaaacagagtcttgggcgaaacctctcatccacctttggcagacgaagtcccctaacttcgcagctgagcaagagtataatgcaacagtggccaggatgaagccacactgtgccatctgcactctgctcatgccgtaccacaagccagatagcagcaatgaagaaaatgatgctagatgggagacaaaattagatgaagtcgttacatcggagggaaagactaagcccctcataccagagatgtgttttatttatagtgaagaaaatatagaatattctccacccaatgccttccttgaagaggatggaacaagtctccttatttcctgtgcaaagtgctgcgtacgggttcatgcaagttgttatggtattccttctcatgagatctgtgatggatggctgtgtgcccggtgcaaaagaaatgcgtggacagcagaatgctgtctctgcaatttgagaggaggtgctcttaagcaaacgaagaacaataagtgggcccatgtcatgtgcgccgttgcggtcccagaagttcgattcactaatgtcccagaaaggacacaaatagatgtaggcagaatacctttacagaggttaaaattgaaatgcatcttctgcagacaccgggttaagagggtctctggagcctgcatccagtgttcctacggtcgctgcccggcctccttccatgtcacttgtgcccatgctgctggggtactgatggagcctgatgactggccttatgtggtgaacattacatgctttcgacataaggtcaaccccaacgtgaagtccaaggcttgcgagaaggtcatttccgtgggtcaaacggtcatcacgaagcatcggaacacccggtattacagttgcagagtgatggctgtgacatcgcagaccttctatgaggtcatgtttgatgatggctcctttagcagagacacatttcctgaggatatcgtgagccgagactgtctgaagctgggcccacctgctgagggagaagtcgtccaagtcaagtggcccgatggcaaactctatggagcaaaatattttggatcaaatattgcccacatgtaccaggttgagtttgaagatggatcccagatagcaatgaagagagaggacatctacactttagatgaagagttacccaagagagtgaaagctcgattttccacagcctctgacatgcgatttgaagacacgttttatggagcagacattatccaaggggagagaaagagacaaagagtgctgagctccaggtttaagaatgaatatgtggccgaccctgtataccgcacttttttgaagagctctttccagaagaagtgccagaagagacagtag

SEQ ID NO: 16489 - DNA, 347 bp, Artificial Sequence
  Synthetic polypeptide
ggctgggcttggtggctcacgcctgtaatcccagcactttgggaggcagctggatcatgagacatgcgaaaagaaccacaattaacactgaagatgtgaagctcttagccaggaggagtaattcactgcatatgcaggaagcggcaggaataaggaaaagcagcctcctgactttcctcgcttggtggtttgagtggacctcccaggccagtgccgggcccctcataggagaggaagcccgggaggtggccaggcggcaggaaggcgcacccccccagcaatctgcgcgccgggacagaatgccctgcaggaacttcttctggaagaccttctcctcctgcaaataa

SEQ ID NO: 16490 - DNA, 269 bp, Artificial Sequence
  Synthetic polypeptide
ggctgggcttggtggctcacgcctgtaatcccagcactttgggaggcagctggatcatgagacatgcgaaaagaaccacaattaacactgaagatgtgaagctcttagccaggaggagtaattcactgctaaaatacatcacagacaaaagtgaagagattgctcagattaacctagaacgaaaagcacagaagaaaaagaagtcagaggatggaagcaaaaattcaaggcagccagcagaggctggagtggtggaaagtgagaattaa

SEQ ID NO: 16491 - DNA, 198 bp, Artificial Sequence
  Synthetic polypeptide
ggctgggcttggtggctcacgcctgtaatcccagcactttgggaggcagctggatcatgagacatgcgaaaagaaccacaattaacactgaagatgtgaagctcttagccaggaggagtaattcactgctaaaatacatcacagacaaaagtgaagagattgctcagattaacctagaacgaaaagcacagaagaaaa

SEQ ID NO: 16492 - DNA, 1464 bp, Artificial Sequence; identical to SEQ ID NO: 9124
  Synthetic polypeptide

SEQ ID NO: 16493 - DNA, 379 bp, Artificial Sequence
  Synthetic polypeptide
tgagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttga

SEQ ID NO: 16494 - DNA, 447 bp, Artificial Sequence
  Synthetic polypeptide
tttggtgccgtgacttggatcagggacctcccttgggagatcaatcccctgtcctcctgctctttgctctgtgagaaagatccacctacgacctcaggtcctcagaccgaccagcccaagaaacatctcaccaatttcaaatccggactattccctgatataaccaggccctttaaaaagtcatttgatgtcaagcatggagtggcacatcaaatttgggattttggtgattgttttccgacacctccaaattatggaaaatactgtgtgagacctaaaaagccagcacaggaggccctgataaactacagtcgacgagggaaaggtgtcctaaagcatcttcatggacggtgcgattctgaaagcaaggtttgctcatctgaggattcagaagctgatcgatactccgattatggctggggaggaccctcatcgccatttaactga

SEQ ID NO: 16495 - DNA, 2609 bp, Artificial Sequence; identical to SEQ ID NO: 8660
  Synthetic polypeptide

SEQ ID NO: 16496 - DNA, 2360 bp, Artificial Sequence; identical to SEQ ID NO: 8661
  Synthetic polypeptide

SEQ ID NO: 16497 - DNA, 2753 bp, Artificial Sequence; identical to SEQ ID NO: 8662
  Synthetic polypeptide

SEQ ID NO: 16498 - DNA, 2291 bp, Artificial Sequence; identical to SEQ ID NO: 8663
  Synthetic polypeptide

SEQ ID NO: 16499 - DNA, 2255 bp, Artificial Sequence; identical to SEQ ID NO: 8664
  Synthetic polypeptide

SEQ ID NO: 16500 - DNA, 2510 bp, Artificial Sequence; identical to SEQ ID NO: 8665
  Synthetic polypeptide

SEQ ID NO: 16501 - DNA, 2348 bp, Artificial Sequence; identical to SEQ ID NO: 8666
  Synthetic polypeptide

SEQ ID NO: 16502 - DNA, 2417 bp, Artificial Sequence; identical to SEQ ID NO: 8667
  Synthetic polypeptide

SEQ ID NO: 16503 - DNA, 2690 bp, Artificial Sequence; identical to SEQ ID NO: 8668
  Synthetic polypeptide

SEQ ID NO: 16504 - DNA, 2741 bp, Artificial Sequence; identical to SEQ ID NO: 8669
  Synthetic polypeptide

SEQ ID NO: 16505 - DNA, 799 bp, Artificial Sequence; identical to SEQ ID NO: 8670
  Synthetic polypeptide

SEQ ID NO: 16506 - DNA, 1786 bp, Artificial Sequence
  Synthetic polypeptide
ctttgcttctcatcaaacagacaaaactctgccactttggggcatctgtgctttctgttccctcagtcctggaacgttctccccatgacctgctgcataaatgggctgtttcttctgcaagctcagctggaatgttaccgcttcagagaccttcttggaaccccccaactcagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaactcagtctggacaagtgctaaggacaagtgcaaacgtaaatcatgtcgtaatcctccagatcctgtgaatggcatggcacatgtgatcaaagacatccagttcagatcccaaattaaatattcttgtcctaaaggataccgactcattggttcctcgtctgccacatgcatcatctcaggcaacactgtcatttgggataataaaacacctgtttgtgacagaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagcccctcagtgcattatacctaacaaatgcacgcctccaaatgtggaaaatggaatattggtatctgacaacagaagcttattttccttaaatgaagttgtggagtttaggtgtcagcctggctttggcatgaaagggccctcccatgtgaagtgccaggccctgaacaaatgggagccagagttaccaagctgctccagggtatgtcagccacctccagatgtcctgcatgctgagcgtacccaaagggacaaggacaacttttcacccgggcaggaagtgttctacagctgtgagcccggctacgacctcagaggatctacgtatttgcactgcacaccccagggagactggagccctgcagcccccagatgtgaagtgaaatcctgtgatgacttcctgggccaacttcctaatggccatgtgctatttccacttaatctccagcttggagcaaaagtggattttgtttgtgatgaaggatttcaattaaaaggcagctctgctagttactgtgttttggctggaatggaaagcctttggaatagcagtgttccagtgtgtgaacgtaaatcatgtgaaactcctccagttccagtgaatggcatggtgcatgtgatcacagacatccatgttggatccagaatcaactattcttgtactacagggcaccgactcattggtcactcatctgctgaatgtatcctctcgggcaatactgcccattggagcatgaagccaccaatttgtcaacaaatcttttgtccaaatcctccagctatccttaatgggagacacacaggaactccccttggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggttcacatgatgctcttatagttggtaagttttatgaagtgtttgctgaggaattctgtcatctttaa

SEQ ID NO: 16507 - DNA, 1553 bp, Artificial Sequence
  Synthetic polypeptide
taccttgcttgtggtaatgcacaatggtacagccattctggaaaaccagttgggaggtttctttaggtgaaacatatacttagaattagcccagcaatcccactcttaggtgtttgccatcgagaaatgaaaacttatgtttgcacaaaaatctgtacatgtttatagcagctcttttcataatcttcaagaaatggaaacaacccaaatgcctttcaatgaatggatgaatggtggtacattccatacaacgaaatatgactcagtaataaacacacctaataccttgggtgaacctcgggcattatctgaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactga

SEQ ID NO: 16508 - DNA, 198 bp, Artificial Sequence
  Synthetic polypeptide
ggctggacgtggtggctcatacttgtattcctagcactttgggaggctgatacagcattaatcaagtctgatctgcgaagacacaacataaatataggaattacaaatgttgatgttaaagctataccagctgacagtcccacagaccaagaaccaaaaacggttatgttgtccaagcagtcagaatcagcaatttga

SEQ ID NO: 16509 - DNA, 504 bp, Artificial Sequence; identical to SEQ ID NO: 7011
  Synthetic polypeptide

SEQ ID NO: 16510 - DNA, 2153 bp, Artificial Sequence; identical to SEQ ID NO: 7012
  Synthetic polypeptide

SEQ ID NO: 16511 - DNA, 818 bp, Artificial Sequence; identical to SEQ ID NO: 7013
  Synthetic polypeptide

SEQ ID NO: 16512 - DNA, 1446 bp, Artificial Sequence; identical to SEQ ID NO: 8572
  Synthetic polypeptide

SEQ ID NO: 16513 - DNA, 104 bp, Artificial Sequence; identical to SEQ ID NO: 8573
  Synthetic polypeptide

SEQ ID NO: 16514 - DNA, 489 bp, Artificial Sequence; identical to SEQ ID NO: 8574
  Synthetic polypeptide

SEQ ID NO: 16515 - DNA, 700 bp, Artificial Sequence
  Synthetic polypeptide
gccaggagcggtggctcacccctgtaatcccagcactttgagatgcagaggcgggcggatcatttgaggccaggagttcgagaccaacctggccaacatggcgaaacgctgtctctactaaaaatacaaaaaaattacctggcatggtggtgcacgcctgtaatcccagctactcgagaggctgttggttctggataactctcgagtgcgtctcaaacccaaagccaggttgacacccaaaatacagaaacttcttaatcgagaagcgagaaactatacactcagttttaaagaagcaaaaatggtgaaaaagttcaaagactccaaaagtgtattgttgatcacttgtaaaacatgcaacagaacagtgaaacatcatggtaaaagtagaagctttgtgtcaacattgaagagcaatcctgccactcctacaagtaaactcagcctgaagacaccagagagaaggactgcaaacccaaatcatgacatgtctggctcgaaaggcaagagcccagcatcggttttcagaacacctacatctggacagtcagtatctacttgctcctcaaagaacaccagcaaaacaaagaaacacttctctcaactaaaaatgttacttagtcagaatgaatcccaaaagattccaaaggtggacttcagaaatttcttatcttctctgaagggtggacttttaaaataa

SEQ ID NO: 16516 - DNA, 2505 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtga

SEQ ID NO: 16517 - DNA, 1101 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttggaggagttctctggccacaccgttggtacagcagctccttccaggctcattcatggaacaggcatggtggcagtcttggagaagagtgccagccccggtcagagaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatga

SEQ ID NO: 16518 - DNA, 1008 bp, Artificial Sequence
  Synthetic polypeptide
ctctccctctccctctccctctccccacggtctccctctccctctctttccatggtctccctctgatgccgagccgaagctggactgtactgctgccatctcggctcactgcaacctccctgcctgattctcctgcctcagcctgcgattgcaggcgcacgccgccacacctgactggttttcgtatttttttggtggagacggggtttcgctgtgttggccgggctggtctccagctcctaaccgcgagtgatccgccagccttggcctcccgaggtgctgggattgcagaccgagtctggttcactcagtgctcaatggtgcccaggctggagtgcagtggtgtgatctcggctcgctacaacctccacctcccagccgcctgccttggcctcccaaagtgccgagattgcagcctctgcccggccgccaccccgtctgggaagtgaggagcgtctctgcctggccgcccatcgtctgggacgtgaggagcccctctgcctggctgcccagtctggaaagtgaggagcgtctctgcccggccgccatcccatctaggaagtgaggagcgtctctgcccggccgcccatcgtctgagatgtggggagcgcctctgccccaccgccccgtctgggatgtgaggagcgcctctgcccagccgcgaccccgtctgggaggttgatctcctatcaagagtttttggcatttgaatctgttttatgtgctccagattccatgttcatagtggctttccagttgtttgacaagagtggaaatggagaggtgacatttggattttggatctggggtaaaggaggagttctctggccacaccgttggtacagcagctccttccaggctcattcatggaacaggcatggtggcagtcttggagaagagtgccagccccggtcagagggaagaaatgaatcctgcattccatttcaaagaaaagatgagaatcccatctccccagtgacatccaatgccttcttccaactttgctga

SEQ ID NO: 16519 - DNA, 2839 bp, Artificial Sequence
  Synthetic polypeptide
caggttatgaaacaaattgattctagcaggccagacataagagagatgattccctggaccatcccaaggaagagtggttaacagatgcaagttgttttatgcatcaggaaaacaggagggctaaatatgctattattagcacaagagaatcaatcaaggcacaagccttgctggcttcgacctcagcagctcaaaaagctgagttaattgaactaactaggcccctgcagttgggaaagaatttaaaagttaacatttacactgattccaagtatgattttttagtgcttcatgcttatgctgcaatttggaatgggtggggactcctgacccccaagggcttttccatacaacatcgttcagattttgagcttgttagagtgctgctttgctgccaaaaagtgagtataattaattgcagaggacatcaaaagagagactgaccatgtaaaaggaaatgcccttgtagatgccacagccaaggcccctgcactgaaagggccaatgaagcttgtgggcgtgctggtcagcatacatagaactgggccagaataccctgaagaagaacgaaaatgggccagggattgcatttcagtccagggcccctcgggctgaatgatggtaataaattactaatgccaagtaccaatcacaggagtataactcagcactttcatgattcttttcaccctagaagggattctttgtttctgttaatgtctcatttgtttataggggtaaatcttttcaagacactaaaacaggtgactcagccctgtgagctttgtgcctgacatgactcaaatggccagcaattttctccttctccagttaaacctgtccaaaattgaggaacctatccaggtgagaactggccactctaatttacccggaagcctttctgcaggagattcaaatatttgctaatgcttactgacaccttcactggttagatcgaggcattccccaccccatctgaaaaatgtttaccagaagaaataactcctcagtttgggtaatccaaaagcctgcaaagtgacaatggcccatctttcacagcaggcgtatcccaaaacctgtcctcagctttaagaatccaatatgaccttcactctgctggagaccacagtcctctggaaaggtgaaagggctaaccctactctaaagaagactccagctaaatcagaggcctgactgtctctaacacccatagcttattgtgggttagaactgctccaaagtaaaacgtataattgagtcctgttgagttcacatgtggaaggcctttcctaaccacagatctcctaatagatgaaaagactcatcaattacaaaaatatgtcatcaatctaggacaggtgcaaaggcactccgtgcatatggaaacaagagtcttcccctcccacatgggaggaaaattcagtttcagctcagctagggatttagtcttactaaagacgcgggaggaagttctccagcgagcagctttccccaacgtggaaaggaccacgcaaggacacctgagctttccaacagatgttcagcgccaggggatccacagttctgggaggtgatctctgatgaacatgccatcgactccgctggcacctaccacggggacagccacctgcagctggagcgcatcaacgtgtactacaacgaggccagcggtggcaggtacgtgccccgcgctgtgctcgtggatctggagccgggcaccatggactctgtgcgctcggggcccttcgggcaggtcttcaggccagacaacttcatcttcggtcagtgtggggccggaaacaactgggccaagggacactacaccgaaggcgcggagctgatggagtcagtgatggacgttgtcagaaaggaggctgagagctgtgactgcctgcagggtttccagctgacccactccctgggtggggggactgggtctgggatgggtacccttctgctcagtaagatccgggaggagtacccagacaggatcataaacacattcagcatcctgccctcgcccaaggtgtcggacaccgtggtggagccctacaacgccaccctctcagtccaccagctcatagaaaacgcagatgagaccttttgcatagataacgaagctctgtatgacatatgttccaagaccctaaaactgcccacacccacctatggtgacctgaaccacctggtgtctgctaccatgagtggggtcaccacgtgcctgcgcttcccgggccagctgaatgctgacctgcggaagctggccgtgaacatggtcccgtttccccggctgcatttcttcatgcccggctttgccccactgaccagccggggcagccagcagtaccgggccttgactgtggctgagcttacccagcagatgtttgatgctaagaacatgatggctgcctgtgacccccgtcacggccgctacctaacggcggctgccattttcaggggtcgcatgcccatgagggaggtggatgaacaaatgttcaacattcaagataagaacagcagttactttgctgactggctccccaacaacgtaaaaacagccgtctgtgacatcccaccccgggggctaaaaatgtcagccaccttcattgggaataatacggccatccaggaactcttcaagcgtgtctcagagcagtttacagcaatgttcaggcgcaaggccttcctccactggtacacgggcgagggcatggatgagatggaattcaccgaggccgagagcaacatgaacgacctggtgtctgaatatcagcaatatcaggatgccacggccgaggaggaggaggatgaggagtatgccgaggaggaggtggcctag

SEQ ID NO: 16520 - DNA, 999 bp, Artificial Sequence
  Synthetic polypeptide
gttactgatcagctccacgactttaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtag

SEQ ID NO: 16521 - DNA, 96 bp, Artificial Sequence
  Synthetic polypeptide
gttactgatcagctccacgactttaggcaaaagaaggggaacgtggcccagaaacactgggttggaccttcgaatttggtcaagtgcaagccctgt

SEQ ID NO: 16522 - DNA, 2158 bp, Artificial Sequence; identical to SEQ ID NO: 514
  Synthetic polypeptide

SEQ ID NO: 16523 - DNA, 124 bp, Artificial Sequence; identical to SEQ ID NO: 515
  Synthetic polypeptide

SEQ ID NO: 16524 - DNA, 166 bp, Artificial Sequence; identical to SEQ ID NO: 516
  Synthetic polypeptide

SEQ ID NO: 16525 - DNA, 1776 bp, Artificial Sequence; identical to SEQ ID NO: 517
  Synthetic polypeptide

SEQ ID NO: 16526 - DNA, 319 bp, Artificial Sequence; identical to SEQ ID NO: 520
  Synthetic polypeptide

SEQ ID NO: 16527 - DNA, 828 bp, Artificial Sequence; identical to SEQ ID NO: 13235
  Synthetic polypeptide

SEQ ID NO: 16528 - DNA, 939 bp, Artificial Sequence; identical to SEQ ID NO: 13236
  Synthetic polypeptide

SEQ ID NO: 16529 - DNA, 951 bp, Artificial Sequence; identical to SEQ ID NO: 13237
  Synthetic polypeptide

SEQ ID NO: 16530 - DNA, 91 bp, Artificial Sequence; identical to SEQ ID NO: 13238
  Synthetic polypeptide

SEQ ID NO: 16531 - DNA, 193 bp, Artificial Sequence
  Synthetic polypeptide
cagaatctctgggagaatgagccagtccttgctgtcggaggaaggggagatcgtagatttgctgctgatgaaaatactcagtttcctgggcattaagtctaagagagaggagcctggaagcagcagggagcagcctgggtctctgtcccagactcgccactctcgaccagcacaagctttgcccaaggactaa

SEQ ID NO: 16532 - DNA, 348 bp, Artificial Sequence
  Synthetic polypeptide
tggtgccaggtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtga

SEQ ID NO: 16533 - DNA, 807 bp, Artificial Sequence; identical to SEQ ID NO: 7401
  Synthetic polypeptide

SEQ ID NO: 16534 - DNA, 453 bp, Artificial Sequence; identical to SEQ ID NO: 7402
  Synthetic polypeptide

SEQ ID NO: 16535 - DNA, 2196 bp, Artificial Sequence; identical to SEQ ID NO: 9550
  Synthetic polypeptide

SEQ ID NO: 16536 - DNA, 1058 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaggagcccctccgcccggcagccaccccgtctgggaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggctggagtgcaatggcatgatcatagctcctggacctcaagccatcctcctgccgcagcctctcaagtatctaggactacaggaaacgatggcatctctttcctcctga

SEQ ID NO: 16537 - DNA, 1847 bp, Artificial Sequence
  Synthetic polypeptide
caccccgtctgggaagtgaggagcgtctctgcctggccgcccatcgtctgggatgtgaggagcccctctgcccggctgcccagtctggaaagtgaggagcttctctgcccggccgccatcccatctaggaagtgaggagcgcctcttcccggctgccatcacatctaggaagtgaggagcgtctctgcccggccgcccatcgtctgagatgtggggaccgcctctgccccgccgccccgtctgggatgtgaggagtgcctctgcccggccgcgaccccgtctgggaggtgaggagcgtctctgcccggccgccccgtctgagaagtgaggagaccctctgcctggcaaccgccccgtctgagaagtgaggagcccctccgcccggcagccgccccgtctgagaagtgaggagcccctccgcccggcagccaccccgtctgggaagtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggatgtgaaatggtctgacttcgggtttcctggaagaaatggacaggaaagtacattgtggattggctccttgggagcccacacaccctgtcatctggactcctatggttgtaacttggtattccaggtacaaggaaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggttctctttgttcccagacactggtggcattacgtagaatccattgatcctgtcactgtcagtataaactcatggattgaactggaagaggatcacctagcccgggtagaagaggcaatcacccgtatgcttgtgtgtgccctgaaaactgcagagaatccacaaaataccagagcctggttaaaccccactgaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatggagaacactttggaaaattgcattgtgccaagagacaacaaataatgagcaacagtgaaaatgcaattgaggaacagattgcctcaaatactactacgactcctcaaacattcatttctacggatgacttgctggactgcttggtgaatccacaagtaaccaggatagtggcacaacttttgatacaaggaagaagtttatga

SEQ ID NO: 16538 - DNA, 2292 bp, Artificial Sequence
  Synthetic polypeptide
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggccctggagggacaggaaagccagaaatggacttcgtgagactcgctcgactgttcgccagggcccgccccatgggactgttcatcctgcaacacctggacccctgtagagccaggtgggcaggaggcagggaggggctgatgcggccaatgtgggcgcccttcagcagctcctcctctcagctgcccctcggccaggagcgtcaggaaaacacgggcagcctgggctctgacccgagccactccaactccacggccacgcaggaagaagacgaggaggaggaggagagttttgggaccctctctgacaaatactcctcccggagactattccgcaaatccgcagcccagttccataacctgcggtttggggaacggagagatgagcaaatggaaccggagcccaaattatggcgaggccggagaaacaccccgtactggtacttcttgcagtgcaaacacctgatcaaggaagggaagctggttgaagccctggacctgtttgagaggcagatgctgaaggaggagcgattgcagcccatggagagcaactacacggtgctgattgggggctgcgggcgggttggctacctgaagaaggccttcaacctctacaaccagatgaaaaagcgggacctggagccctcggacgccacctacacggccctgttcaacgtctgtgccgagtccccctggaaggactcagctctacagagcgccctgaagctccggcagcagctgcaggccaaaaacttcgagctcaacttgaaaacataccacgcgctgctgaagatggctgccaagtgcgcagaccttaggatgtgcctcgatgtgttcaaggaaatcatccacaaagggcacgtggtcacagaggagaccttcagtttcctgctcatgggctgcatccaagacaagaagacaggcttccggtacgccctccaggtgtggcggctgatgctgagtctagggctacagccgagccgggacagctacaacctgctgttggtggcagctcgggactgtggcctaggggacccccaggtggcctcagagctgcttctgaagcccagggaggaggcgactgtgcttcagcccccagtgagcaggcagcggccaaggaggacagcccaggccaaggcaggcaacctcatgtcagccatgctgcatgtggaggccctggagaggcagctgtttctggaaccttctcaggcacttgggcctccagagcctccggaagccagagtgcccggcaaggcccaaccagaggtggatactaaggcagagcccagccacacagcagccctcaccgcagtggccctgaagccacctcccgtggagctggaagtcaacctcctgacccccggggccgttccccctacagtggtctcctttggaacggtgaccaccccagctgaccggctggccttgatagggggcctggagggcttcctgagcaagatggcagagcacaggcagcagcccgacatcaggaccctcacgctactggccgaggtggtggagtccgggagtcctgcagagtccttgctgctggccctcctggatgagcaccaggtagaggccgacctgacattctttaacacgctggtgagaaagaagagcaagctgggagacctggagggggccaaggcgctgttgccggtcctggcaaagaggggcctcgtccccaacctgcagacattctgcaacctggccatcgggtgccacaggccgaaggacggtctacagcttctcacagacatgaagaagtcccaggtgacccccaacactcacatctacagtgccctcatcaacgcggccatcaggaagctgaactacacctatctcatcagcatcttgaaggacatgaagcagaacagggtcccggtgaacgaagtggtcatccgccagctggagtttgcagcccagtaccctcccacctttgaccggtaccaagggaagaacacctacctggagaagattgacggcttccgagcctattacaagcagtggctgacagtgatgcccgcagaggaaaccccgcacccctggcagaagttccggaccaagccccagggggaccaggacaccggcaaggaggctgatgacggatgtgcccttgggggcaggtga

SEQ ID NO: 16539 - DNA, 207 bp, Artificial Sequence
  Synthetic polypeptide
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggatatggacaagcagcgagtgtggagggtgcctaccgactctga

SEQ ID NO: 16540 - DNA, 192 bp, Artificial Sequence
  Synthetic polypeptide
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagagagcacgagcggctccgcaaataccactga

SEQ ID NO: 16541 - DNA, 309 bp, Artificial Sequence
  Synthetic polypeptide
taaggatcaatcgatttagcatgtgaaagacacttggaacgctgcgtggcccacataccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctcaagcacgagcggctccgcaaataccactga

SEQ ID NO: 16542 - DNA, 4494 bp, Artificial Sequence
  Synthetic polypeptide
tggccaataaacacatgaggagatgtccaactttactaataatcaaagaaatattaattaaaataacagtcacttttttttctttcagaatgacaagataatgaaaaatgataatcccaatattgccaagggttttgggaaaatggacacttctacaacttgtgatgagattataaattattaaaaaaacttttcagggaaacaatttggcatttaagatttgttagtggaagtcgagatggaacggcaagaatttggcagtatcagcaacaagaatggaagagtatagtgctagacatggctactaaaatgactggcaataatttgccatctggagaagacaagatcactaaacttaaggtgactatggtggcctgggatcgctatgataccacagttattactgcagtgaacaattttcttttgaaagtgtggaattctatcacaggacagcttcttcatacattatctggacatgatgatgaagtattcgttctagaagcccatccatttgatcaaaggatcatactttcagcaggtcatgatgggaacatttttatttgggaccttgaccgggggaccaaaattcggaattactttaacatgattgaaggccaaggccatggtgcggtgtttgattgtaaattttcaccagatggaaaccattttgcctgcacagattctcatggacatttgctgctttttggttttggatgcagtaaatactacgaaaagattccagatcagatgttcttccacacggattatcgtcctcttattcgtgatgccaataactatgtattggatgaacaaacccaacaagctcctcacctcatgcctcctccatttttggtggatgttgatggaaatcctcatcccacaaaattccaacggttggtaccaggacgggaaaattgtaaagatgaacagcttataccacagctgggatatgtggctaatggtgatggtgaggtagtagaacaggtaattgggcagcaaaccaatgaccaagatgagagcattcttgatggaataatcagggagctgcagagagaacaagacctgagactaattaatgaaggagatgttccacatttaccagttaatagagcatactctgttaatggtgctctgagaagtccaaacatggacatatcttcttccccaaacatcaggcttcgaagacatagtagtcaaattgaaggtgttagacaaatgcataacaatgctcctcggagccagatggccactgaaagagatctcatggcgtggagcagaagagtggtggtcaatgaactaaataatggggttagtagggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttccccatttgtcccacaaatgggagatgagcttatctattttaggcaaggacatgaagcttatgttcgggctgtaaggaaatcgaaaatatacagtgttaatttacaaaaacagccatggaacaaaatggatctcagggagcaagagtttgttaagattgtaggaatcaaatatgaggttggcccacccacactgtgctgcttgaagcttgcatttctggacccaatttcaggcaaaatgactggagaatctttttccattaagtatcatgacatgccggatgtcattgacttccttgtgctacatcagttttataatgaagccaaagaaaggaactggcagattggtgatagattccgcagtataatagatgacgcctggtggtttgggactgtggagagtcagcagccttttcaaccagagtatcctgatagttctttccagtgttacagtgttcactgggacaataatgagagagaaaagatgagcccatgggatatggagccaattccagaaggaactgcctttccagatgaagttggtgctggtgttcctgtctcccaggaagaattgactgctttgctatacaaaccccaggaaggagagtggggggctcattccagagacgaagaatgtgaacgggttattcagggcatcaaccaccttctttccctggattttgccagcccttttgctgttccagtggatctcagtgcctaccccttgtattgtactgtagttgcttatccaactgacctcaataccatcaggcggagacttgaaaatcgcttttacaggagaatatcagcattaatgtgggaggtacgctatattgaacataatgccaggactttcaatgagccagacagtcctatagttaaagcagctaaaattgtaactgatgtcttacttcgatttattggggatcagagctgtactgatatactggatacttataataaaattaaagcagaagaacgaaacagtactgatgcagaggaggatacagaaattgttgatttagattcagacggtcctggtacttcatctggaagaaaggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccaggtcatcaggagcaagagggagaatcctcagagtctgttgttccagaaagacaacaagattcatctctttctgaggattatcaagatgttatagatactcctgtggacttcagcactgtgaaagaaactttggaagcaggaaactatggtagtcctctggaattttataaggatgttcgccaaatattcaacaactccaaagcttatacctctaataaaaagtcaaggatctatagcatgatgctgcgattatctgccttatttgaaagtcatatcaaaaatatcatctctgaatataagtcagcaatccagagtcagaagaggagaaggccacggtacagaaaacgtctaagaagcagcagcagttcattatctagtagtggagcacctagtccaaaagggaagcagaaacaaatgaagttgcagcctaaaaatgaccagaatacctcagtatctcatgccaggactagctctcctttctcatctcctgtttcagatgctgctgaagggctttcactatatctacttgatgatgagccagatgggccattttcttcatcgagcttcggtggatatagccgaagtggaaatagccatgacccagggaaagccaaatcatttcggaatagagttttgccagttaaacaagatcactcccttgatggaccccttacaaatggtgatggcagagagccccggacaggaatcaagagaaaactacttagtgcatcagaagaagatgaaaacatgggaggagaagataaagagaaaaaagaaacaaaagagaaatctcatttatccacctcagagagtggagagttaggatccagtttaagttctgaaagtacctgtggttctgactctgactctgaatcaacttccagaacagatcaagattacgtagatggagaccatgattatagcaaattcatacaaaccagacctaaaagaaaactcagaaagcaacatggcaatggaaaaagaaattggaagaccagaggcacaggaggaagaggcagatggggaagatggggtagatggagtagaggaggcagaggaagaggaggcaggggacgagggagtcgaggaagaggtggaggtggcactagggggaggggaagagggagaggaggaagaggtgcttctagaggagctaccagagccaaacgagcacgtattgcagatgatgaatttgataccatgttttcaggacgtttcagtagactgcctcgaattaaaacaagaaaccaaggcaggaggactgttttatataatgatgattctgataatgacaattttgtgtccactgaggatcctctgaatcttggtacatccagatcaggcagagtgcgtaaaatgacagaaaaagccagggttagccatctcatgggatggaattattaa

SEQ ID NO: 16543 - DNA, 711 bp, Artificial Sequence
  Synthetic polypeptide
aaaacactgataataccaactgctggcaaggatgtagagaaacaggaaggaactctcatttattactggtaggactgaaaactggcacagccactttaaaagtcagtttggcagtttcttatgaaactaaatatgttattatatgatgcagcgattgtgctccttgatattcactcaaaaaagttgaaaacttacattcacacaaaagcctgcagacaaatgttcatagcagcattattcataattgccagaacttggaagcagccattcatttcttcagtagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaa

SEQ ID NO: 16544 - DNA, 507 bp, Artificial Sequence
  Synthetic polypeptide
aaaacactgataataccaactgctggcaaggatgtagagaaacaggaaggaactctcatttattactggtaggactgaaaactggcacagccactttaaaagtcagtttggcagtttcttatgaaactaaatatgttattatatgatgcagcgattgtgctccttgatattcactcaaaaaagttgaaaacttacattcacacaaaagcctgcagacaaatgttcatagcagcattattcataattgccagaacttggaagcagccattcatttcttcagtagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcagatgtgcagtaa

SEQ ID NO: 16545 - DNA, 1401 bp, Artificial Sequence; identical to SEQ ID NO: 7274
  Synthetic polypeptide

SEQ ID NO: 16546 - DNA, 1421 bp, Artificial Sequence
  Synthetic polypeptide
ctcacgcctctaatcctagcactttaggaggccaagtcaggaggagcgcatgagcccaggagacctgcctggacaacatagcaagactccatctctacaaaaaatggaaaaaaaaattagcaggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctatgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactga

SEQ ID NO: 16547 - DNA, 1451 bp, Artificial Sequence
  Synthetic polypeptide
ctcacgcctctaatcctagcactttaggaggccaagtcaggaggagcgcatgagcccaggagacctgcctggacaacatagcaagactccatctctacaaaaaatggaaaaaaaaattagcaggagggctgtcggtggcggtgcctggggagatccgaggctatgagctggcacaccagcggcatgggcggctgccctgggctcgcctcttccagcccagcatccagctggcccgccagggcttccctgtgggcaagggcttggcggcagtcctggaaaacaagcggactgtcatcgagcagcagcctgtcttgtggtatgtgttctgccgggatagaaaggtgcttcgggagggggagagactgaccctgccgcggctggctgacacctatgagatgctggccatcgagggtgcccaggccttctacaacggcagcctcatggcccagattgtgaaggacatccaggcggctgggggcattgtgacagctgaggacctgaacaactaccgtgctgagctgatcgagcacccgctgaacatcagcctgggagacgcggtgctgtacatgcccagtgcgcggctcagcgggcccgtgctggccctcatcctcaacatcctcaaagggtacaacttctcccgggagagcgtggagacccccgagcagaagggcctgacgtaccaccgcatcgtagaggctttccggtttgcctacgccaagaggaccctgcttggggaccccaagtttgtggatgtgactgaggtggtccgcaacatgacctctgagttcttcgctgcccagctccggtcccagatctctgaccacaccactcacccgatctcctactacaagcccgagttctacacgccggatgacgggggcactgctcacctgtctgtcgtcgcagaggacggcagtgctgtgtccgccaccagcaccatcaacctctactttggctccaaggtctgctccccggtcagtgggatcctgttcaataatgaatggacgacttcagctctcccagcattcaccaatgagtttggggcacccccctcacctgccaatttcatccagccagggaagcagccgctcttgtccatgtgcctgacgatcatggtgggccaggacggccaggtccggatggtggtgggagctgctgggggcacgcagatcaccacagacactgcactggccatcatctacaacctctggttcggctatgacgtgaagagggccgtggaggagccccggctgcacaacaagcttctgcccaacgtcacgacagtggagagaaacattgaccaggcagtgactgcagccctggagacccggcaccatcacacccagatcgcgtccaccttcatcgctgtggtgcaagccatcgtccgcacggctggtggctgggcagctgcctcggactccaggaaaggcggggaacctgctggctactga

SEQ ID NO: 16548 - DNA, 3887 bp, Artificial Sequence; identical to SEQ ID NO: 12657
  Synthetic polypeptide

SEQ ID NO: 16549 - DNA, 3914 bp, Artificial Sequence; identical to SEQ ID NO: 12658
  Synthetic polypeptide

SEQ ID NO: 16550 - DNA, 4010 bp, Artificial Sequence; identical to SEQ ID NO: 12659
  Synthetic polypeptide

SEQ ID NO: 16551 - DNA, 3773 bp, Artificial Sequence; identical to SEQ ID NO: 12660
  Synthetic polypeptide

SEQ ID NO: 16552 - DNA, 581 bp, Artificial Sequence; identical to SEQ ID NO: 12661
  Synthetic polypeptide

SEQ ID NO: 16553 - DNA, 204 bp, Artificial Sequence; identical to SEQ ID NO: 755
  Synthetic polypeptide

SEQ ID NO: 16554 - DNA, 459 bp, Artificial Sequence; identical to SEQ ID NO: 6510
  Synthetic polypeptide

SEQ ID NO: 16555 - DNA, 504 bp, Artificial Sequence; identical to SEQ ID NO: 6511
  Synthetic polypeptide

SEQ ID NO: 16556 - DNA, 516 bp, Artificial Sequence; identical to SEQ ID NO: 13896
  Synthetic polypeptide

SEQ ID NO: 16557 - DNA, 446 bp, Artificial Sequence; identical to SEQ ID NO: 13897
  Synthetic polypeptide

SEQ ID NO: 16558 - DNA, 5350 bp, Artificial Sequence; identical to SEQ ID NO: 655
  Synthetic polypeptide

SEQ ID NO: 16559 - DNA, 861 bp, Artificial Sequence
  Synthetic polypeptide
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaa

SEQ ID NO: 16560 - DNA, 616 bp, Artificial Sequence
  Synthetic polypeptide
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcacctgcagaaacttaatagccagtatcaggggatggctgctgccactccag

SEQ ID NO: 16561 - DNA, 530 bp, Artificial Sequence
  Synthetic polypeptide
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaa

SEQ ID NO: 16562 - DNA, 378 bp, Artificial Sequence
  Synthetic polypeptide
ggcagcggggattagggctgagggtaaaaactttgcagacagcctgatccagattcaaacactcagccacgtggctatgtgaacttgggcaatttcccgaggctctgtttcattcacctttggtaaaccctacctcaaagggctgtcctgggaattaaatgagatgatggatggggaacatgccaggcccagcgctggagcacagaggttctcgcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaac

SEQ ID NO: 16563 - DNA, 255 bp, Artificial Sequence; identical to SEQ ID NO: 12596
  Synthetic polypeptide

SEQ ID NO: 16564 - DNA, 2328 bp, Artificial Sequence
  Synthetic polypeptide
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagaggaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaa

SEQ ID NO: 16565 - DNA, 795 bp, Artificial Sequence
  Synthetic polypeptide
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgctacctcttggaagaaagtccttgtcctttgagactcagaaggccccacgctccagtatgccatcatga

SEQ ID NO: 16566 - DNA, 729 bp, Artificial Sequence
  Synthetic polypeptide
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctgtga

SEQ ID NO: 16567 - DNA, 858 bp, Artificial Sequence
  Synthetic polypeptide
caatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattagaaattcggaataccaggaacttaacttacatagaccctgatgccctcaaagagctccccctcctaaagttccttggcattttcaacactggacttaaaatgttccctgacctgaccaaagtttattccactgatatattctttatacttgaaattacagacaacccttacatgacgtcaatccctgtgaatgcttttcagggactatgcaatgaaaccttgacactgaagctgtacaacaatggctttacttcagtccaaggatatgctttcaatgggacaaagctggatgctgtttacctaaacaagaataaatacctgacagttattgacaaagatgcatttggaggagtatacagtggaccaagcttgctggtagaaaatgttgctgtctcgggtaaaggcttctgcaagtccctcttttcctggctgtataggctacctcttggaagaaagtccttgtcctttgagactcagaaggccccacgctccagtatgccatcatga

SEQ ID NO: 16568 - DNA, 239 bp, Artificial Sequence
  Synthetic polypeptide
ggctggcagtagtggttcgtgcctatagtcccagcactttgggtggctgaggcgggaggttcatttaaggccaggagttaaagaccagcccaggcaacaacagtgagaccctgactctacaaaacaaaaacaaacaaacaaacaaaaaaattagccagaggaactgtgagagtgacactgaggaggacatcgccaggaggaaagccctccacccacggaggaggagcagcacctcctaa

SEQ ID NO: 16569 - DNA, 160 bp, Artificial Sequence
  Synthetic polypeptide
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagtgcttgtgactaa

SEQ ID NO: 16570 - DNA, 777 bp, Artificial Sequence
  Synthetic polypeptide
cagggccaccatggatggtcgagcagtgtgtgtcccgcactaggtcctgcactggccgaggatgggggctgacgtccacccatgtgctgctggacaagccatgtgccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtag

SEQ ID NO: 16571 - DNA, 505 bp, Artificial Sequence
  Synthetic polypeptide
cagggccaccatggatggtcgagcagtgtgtgtcccgcactaggtcctgcactggccgaggatgggggctgacgtccacccatgtgctgctggacaagccatgtgccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctc

SEQ ID NO: 16572 - DNA, 1629 bp, Artificial Sequence; identical to SEQ ID NO: 8070
  Synthetic polypeptide

SEQ ID NO: 16573 - DNA, 1500 bp, Artificial Sequence; identical to SEQ ID NO: 8071
  Synthetic polypeptide

SEQ ID NO: 16574 - DNA, 676 bp, Artificial Sequence; identical to SEQ ID NO: 13076
  Synthetic polypeptide

SEQ ID NO: 16575 - DNA, 466 bp, Artificial Sequence; identical to SEQ ID NO: 13077
  Synthetic polypeptide

SEQ ID NO: 16576 - DNA, 2053 bp, Artificial Sequence; identical to SEQ ID NO: 13078
  Synthetic polypeptide

SEQ ID NO: 16577 - DNA, 2071 bp, Artificial Sequence; identical to SEQ ID NO: 13079
  Synthetic polypeptide

SEQ ID NO: 16578 - DNA, 558 bp, Artificial Sequence; identical to SEQ ID NO: 13080
  Synthetic polypeptide

SEQ ID NO: 16579 - DNA, 421 bp, Artificial Sequence; identical to SEQ ID NO: 13081
  Synthetic polypeptide

SEQ ID NO: 16580 - DNA, 3871 bp, Artificial Sequence
  Synthetic polypeptide
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16581 - DNA, 3898 bp, Artificial Sequence
  Synthetic polypeptide
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16582 - DNA, 3994 bp, Artificial Sequence
  Synthetic polypeptide
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16583 - DNA, 3757 bp, Artificial Sequence
  Synthetic polypeptide
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16584 - DNA, 565 bp, Artificial Sequence
  Synthetic polypeptide
agacagacctaggtccacatctcagctctgccactcagcagccctgagctcttgggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 16585 - DNA, 3125 bp, Artificial Sequence
  Synthetic polypeptide
ggcagaattctaagatggccctccaagattcccagcctctgatgtattctcctacttattcaaacactaatctaagaattgctgtgaagagattttaggggtgtaattaatgttccaaatcattgaccttaagaaagggagatcatcctggtgggcctgacctaatcccatgagtctttaaaaactcagtgtttctctgctgatttcagaagtcagagagaagcatatgacacgttcagaagaaaggaactgccatattgtggacaaggtcacatggcagggaatggtgggcagcctctagaagctaagagcaacccccagctgacagccagcaagacatcagagacttcagtcctactgccccagaaactgaattctgccaacaacctggacgagcctggacagaaacctgagcccagagtgagaaatgcagccccagccaacacctggatttcagcctgatgagaccctgaggagagaatccagtcatgttgcatctggaattctgacctagagaactgtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtag

SEQ ID NO: 16586 - DNA, 1601 bp, Artificial Sequence
  Synthetic polypeptide
ggcagaattctaagatggccctccaagattcccagcctctgatgtattctcctacttattcaaacactaatctaagaattgctgtgaagagattttaggggtgtaattaatgttccaaatcattgaccttaagaaagggagatcatcctggtgggcctgacctaatcccatgagtctttaaaaactcagtgtttctctgctgatttcagaagtcagagagaagcatatgacacgttcagaagaaaggaactgccatattgtggacaaggtcacatggcagggaatggtgggcagcctctagaagctaagagcaacccccagctgacagccagcaagacatcagagacttcagtcctactgccccagaaactgaattctgccaacaacctggacgagcctggacagaaacctgagcccagagtgagaaatgcagccccagccaacacctggatttcagcctgatgagaccctgaggagagaatccagtcatgttgcatctggaattctgacctagagaactgtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcagatgcagttag

SEQ ID NO: 16587 - DNA, 250 bp, Artificial Sequence; identical to SEQ ID NO: 6839
  Synthetic polypeptide

SEQ ID NO: 16588 - DNA, 305 bp, Artificial Sequence; identical to SEQ ID NO: 6836
  Synthetic polypeptide

SEQ ID NO: 16589 - DNA, 1426 bp, Artificial Sequence
  Synthetic polypeptide
atagcagttaagagatgaaccctgcagcctgacttcctttgctagaatcctggcactgttacttattccttgtatgtctctaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctga

SEQ ID NO: 16590 - DNA, 425 bp, Artificial Sequence
  Synthetic polypeptide
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaa

SEQ ID NO: 16591 - DNA, 1215 bp, Artificial Sequence
  Synthetic polypeptide
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattga

SEQ ID NO: 16592 - DNA, 288 bp, Artificial Sequence
  Synthetic polypeptide
ggccaggcgcagtggcttgcgcctataatcccagcatattgggaggccgaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcc

SEQ ID NO: 16593 - DNA, 4061 bp, Artificial Sequence
  Synthetic polypeptide
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16594 - DNA, 4088 bp, Artificial Sequence
  Synthetic polypeptide
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16595 - DNA, 4184 bp, Artificial Sequence
  Synthetic polypeptide
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagaggcgtcgggagaaggctggaaggggcaggatcctttcagggacctgcacagcctcctgatggagatccaggctctgcgcttgcaactagaaaggagcatcgaaaccagcagcactctgcagagcaggctcaaggaacagctggcaaggggggcagagaaggcacaggaaggagccctcactctggctgtccaagccgtgtccatccctgaggtgccccttcagcctgacaaacacgatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16596 - DNA, 3947 bp, Artificial Sequence
  Synthetic polypeptide
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagcttctggctagcaaggaggacgaggacacgatcaaaattggggaggatgacgagattaatttcctgagtgaccagcatttgcagcagagtaatgagattatgaaagacctttccaaaggaggctgcaaaaatggatacttaaggcacacggagtctaagatttcagattgtgatggggcccacgcacctggctgcctagaagaaggtgcattcataaacctgcttgcccctttgttcaatgagaaggccacattattactggaatccaggccagaccttctgaaagtggtacgggaactgcttctgggacaactattcttgacagagcaggaagtttctggagaacaccttgatggtaaaactgagaagacacctaagcaaaaaggtgaacttgtacattttgtccaaaccaactcattttccaagccacatgatgaactgaagttgtcttgtgaggcccagctagtaaaggcaggcgaagtgcccaaggtaggactgaaagatgcctcagtgcagactgtggccacggagggcgacctgctgagattcaagcatgaagcaacaagagaggcttgggaagagaaaccgatcaacactgcactcagcgcagagcatcggccagagaacctgcacggggtgcctgggtggcaggctgccctcctttccctccctggtattaccaacagagaggctaagaagtcccgcttgccaatcctaataaaaccatcccggtcattaggaaatatgtatcgtctccctgccacccaggaggtggtgacgcagctgcagagccagatcttggagctgcagggggagctgaaggagtttaaaacttgtaataagcaacttcaccaaaagttaattctggctgaagcagtgatggaggggaggccaacgcccgacaaaacgttgctgaatgctcagccccctgtgggagcagcctaccaggacagcccaggagagcagaaaggaattaaaaccacatcttctgtctggagagacaaggaaatggacagtgatcagcaaagaagctacgagattgactctgagatttgcccacctgatgaccttgccagcttgccatcatgcaaagaaaatcctgaagatgttctgagcccaacttcagtagctacttacctgagttccaagagtcagccttctgctaaagtcagtgtgatggggactgatcagtcagagagcattaatacctcaaatgagacagaatacttaaaacagaaaatccatgacttggaaactgagctggaaggctaccagaatttcatatttcagcttcaaaagcactcccagtgcagtgaggccataattacagttttgtgtgggacagaaggggcccaggatggcttgagcaagcccaagaatggttctgatggggaagaaatgaccttttcaagtttgcaccaagtgcgatacgtgaaacacgtgaaaatcctcggtccgctggccccagagatgattgacagcagggtgctggagaacctcaaacagcagctggaggaacaggaatacaagctgcagaaggagcagaatttgaacatgcaacttttcagtgagatccataatctgcagaataagttcagagatctctcacctcccagatacgattcattagttcagtcccaagccagggagctctcccttcaacggcagcagattaaggatggccatggcatctgtgtcatctcccgtcaacacatgaacaccatgattaaggcatttgaggagttgctgcaggccagtgatgtggattactgtgtggccgagggtttccaggaacagctgaatcaatgtgctgagctgctggagaaattggaaaagctatttctcaacggaaaatcagttggagtggaaatgaacacccagaatgaactgatggagaggattgaggaagacaacttaacctaccaacatcttctgcctgaatctcctgagccttcagcctctcatgcgctctctgattatgaaacatctgaaaagtccttcttctcacgagaccagaagcaagataatgagacagagaagacttcagttatggtgaacagtttttctcaagacttactaatggaacacatacaggaaattcgaactttgagaaagcgtttagaagaatctattaaaacaaatgagaagctacggaaacagttggaacggcaaggatctgaatttgttcaaggttctacaagcatttttgcttctggttcagagcttcatagttctctaacatcagaaattcatttcttgaggaagcagaaccaggccctcaatgcaatgctcattaaaggatccagagataaacagaaggagaatgacaaattacgagagtccctctccaggaagaccgtgagcctggagcaccttcagcgggagtatgccagcgtgaaggaagaaaatgaaaggctgcagaaagaaggcagcgagaaggagagacacaaccagcagctgatccaggaggtccgctgcagcggccaggagctgagcagggtgcaggaggaggtgaagttgaggcagcagctgctctcacagaatgacaagctattgcagtctctccgagtggagctgaaggcgtatgagaagctggatgaagagcacaggagactgagagatggtgacaaatatcccatggaaagtgataattcatttgatctgtttgattcctcccaggcagtgacaccaaaatcagtttcagagactcctccactctctgggaatgacacggactccctctcctgcgacagtggcagttcggcaactagcactccgtgtgtgtcccgcctggtcactggccaccacctgtgggccagcaagaatggccgccatgtcctgggcctgattgaggactatgaggccctgctcaaacagatcagccagggacagaggctccttgctgaaatggacattcaaacccaagaggctcccagctccacaagtcaagagctgggaacaaagggtccacacccagcaccactgagcaagtttgtgagcagtgtgagcacggccaagctgaccctggaagaggcctacaggcggctgaagcttctctggagagtctcactccccgaggatggccagtgcccccttcactgtgagcagattggagaaatgaaggcagaggtcaccaaactacataaaaaattgtttgaacaagaaaagaagttgcaaaacaccatgaagcttttgcagctgagcaagcgccaggaaaaagtcatctttgatcaattggtcgtaacccacaaaatccttcggaaggccagaggaaacctggagcttaggcctgggggagcccatccaggaacatgcagtcccagcagaccaggctcctga

SEQ ID NO: 16597 - DNA, 755 bp, Artificial Sequence
  Synthetic polypeptide
agacagacctaggtccacatctcagctctgccactcagcagccctgagctcttgggtaagtaatttctcaccctgagcctcagtgtgtttgtgaaattgagattggctggtctgcctacttacctacctacttagatgtctacctgctttacagggttgtgttgaaactagagaggacactgtgtaaagacctaatacttcctggcatgtagtaagcactcagtaaatgtatcaacaacctgcaggctgagttaaacaagatttttgccctgcggaagcaactggagcaggatgtgctttcatatcagaatttgcggaagaccttggaggagcagatcagcgaaattcggaggcgggaagaagaatcattttcactttatagtgatcaaacatcttatctaagtatttgccttgaagaaaacaatcggtttcaagtggaacatttttctcaagaagaacttaagaaaaaggtcagtgaccttatacagctagtgaaggagctgtatacagacaaccagcacctgaagaaaaccatttttgatctctcctgcatgggtttccagggaaatgggtttccagatagacttgcgtctacagaacaaacagagacatcactgacttattcatacatattcatgctgcacacttttttgggttgcattttcacaccattccatgctccatgtagcttctggctagcaaggaggacgaggacacgatcaaaattggggaggatgacgagattaatttcctga

SEQ ID NO: 16598 - DNA, 852 bp, Artificial Sequence
  Synthetic polypeptide
gagcttggcacctcatagtttgctggaacattatcagatggcttagggaagacgatggacaatcggcatcagtcagagcgggagtacatcaggtaccatgcagccacaagtggtgaacaccttgtagccggcatccatggcctggctcatggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggactcaagcacagagggttcggaaaccgcgttgctgcacggggccccaggggctgcttccccgatattctgagagccaggcggaaggacaggagcagctcttcaaactcacagacaacatacaggacgaattcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtccatgtgaaatctgaggtccttgctgtcaagttgtcacaagaaataaactacgcaaagagcctctactatgaacagcagcttatgttaagactcagcgaaaaccgagagcagctggagctggactcctga

SEQ ID NO: 16599 - DNA, 54 bp, Artificial Sequence
  Synthetic polypeptide
gagccacagcttatccagggttagatcacaaaggcaacaggtgcttgtgactaa

SEQ ID NO: 16600 - DNA, 412 bp, Artificial Sequence
  Synthetic polypeptide
cttggggatgttattcaccacctcaagcatcaattttctgagtctaatataggtccaaacacccccctctggcttgttgaaaggactgaaagagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctga

SEQ ID NO: 16601 - DNA, 193 bp, Artificial Sequence
  Synthetic polypeptide
cttggggatgttattcaccacctcaagcatcaattttctgagtctaatataggtccaaacacccccctctggcttgttgaaaggactgaaagagggcatcctgtacctgaaccaggaggtgcccaaggagttactggaattcctgagacttcggcacttccccacagaccccaaggctagcaactgggggtaa

SEQ ID NO: 16602 - DNA, 485 bp, Artificial Sequence
  Synthetic polypeptide
agctttagcttcgtttgtagaagaagggaacagttaactgaggcattgcaaggcgtaaatgaaaatatacgtaatggacttcacacagtatccaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaa

SEQ ID NO: 16603 - DNA, 1269 bp, Artificial Sequence; identical to SEQ ID NO: 616
  Synthetic polypeptide

SEQ ID NO: 16604 - DNA, 1134 bp, Artificial Sequence; identical to SEQ ID NO: 617
  Synthetic polypeptide

SEQ ID NO: 16605 - DNA, 501 bp, Artificial Sequence; identical to SEQ ID NO: 618
  Synthetic polypeptide

SEQ ID NO: 16606 - DNA, 1321 bp, Artificial Sequence; identical to SEQ ID NO: 619
  Synthetic polypeptide

SEQ ID NO: 16607 - DNA, 1197 bp, Artificial Sequence; identical to SEQ ID NO: 620
  Synthetic polypeptide

SEQ ID NO: 16608 - DNA, 1203 bp, Artificial Sequence; identical to SEQ ID NO: 621
  Synthetic polypeptide

SEQ ID NO: 16609 - DNA, 1131 bp, Artificial Sequence; identical to SEQ ID NO: 622
  Synthetic polypeptide

SEQ ID NO: 16610 - DNA, 642 bp, Artificial Sequence; identical to SEQ ID NO: 623
  Synthetic polypeptide

SEQ ID NO: 16611 - DNA, 554 bp, Artificial Sequence; identical to SEQ ID NO: 12679
  Synthetic polypeptide

SEQ ID NO: 16612 - DNA, 473 bp, Artificial Sequence; identical to SEQ ID NO: 12680
  Synthetic polypeptide

SEQ ID NO: 16613 - DNA, 479 bp, Artificial Sequence; identical to SEQ ID NO: 12681
  Synthetic polypeptide

SEQ ID NO: 16614 - DNA, 719 bp, Artificial Sequence
  Synthetic polypeptide
gtgagaggaaggctgggctttggcgtcagaaaggccgaggtttaagtgctctccagctgcttacatgctgagtggctgtgggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctga

SEQ ID NO: 16615 - DNA, 296 bp, Artificial Sequence
  Synthetic polypeptide
gtgagaggaaggctgggctttggcgtcagaaaggccgaggtttaagtgctctccagctgcttacatgctgagtggctgtgggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagggcttaa

SEQ ID NO: 16616 - DNA, 387 bp, Artificial Sequence; identical to SEQ ID NO: 544
  Synthetic polypeptide

SEQ ID NO: 16617 - DNA, 540 bp, Artificial Sequence; identical to SEQ ID NO: 545
  Synthetic polypeptide

SEQ ID NO: 16618 - DNA, 303 bp, Artificial Sequence; identical to SEQ ID NO: 547
  Synthetic polypeptide

SEQ ID NO: 16619 - DNA, 736 bp, Artificial Sequence; identical to SEQ ID NO: 13712
  Synthetic polypeptide

SEQ ID NO: 16620 - DNA, 241 bp, Artificial Sequence; identical to SEQ ID NO: 13713
  Synthetic polypeptide

SEQ ID NO: 16621 - DNA, 226 bp, Artificial Sequence; identical to SEQ ID NO: 13714
  Synthetic polypeptide

SEQ ID NO: 16622 - DNA, 211 bp, Artificial Sequence; identical to SEQ ID NO: 13715
  Synthetic polypeptide

SEQ ID NO: 16623 - DNA, 162 bp, Artificial Sequence; identical to SEQ ID NO: 13716
  Synthetic polypeptide

SEQ ID NO: 16624 - DNA, 147 bp, Artificial Sequence; identical to SEQ ID NO: 13717
  Synthetic polypeptide

SEQ ID NO: 16625 - DNA, 146 bp, Artificial Sequence; identical to SEQ ID NO: 13718
  Synthetic polypeptide

SEQ ID NO: 16626 - DNA, 124 bp, Artificial Sequence; identical to SEQ ID NO: 13719
  Synthetic polypeptide

SEQ ID NO: 16627 - DNA, 299 bp, Artificial Sequence
  Synthetic polypeptide
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaaaaattttcagaagcacatgtattataacagagattggtacaagcgcaattttgccatcaccttcttcatgggaaaagtggccctggaaaggatttggaacaagcttaaacagaaacaaaagaagaggagcaactag

SEQ ID NO: 16628 - DNA, 1877 bp, Artificial Sequence
  Synthetic polypeptide
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaaaaattttcagaagcacatgtattataacagaatgtatgacaacatgtccacaatggtgtacataaaggaagacaagttggagaagcttacacaggatgaaattatttctaagacaaagcaagtaattcaggggctggaagctttgaagaatgagcacaattccattttacaaagtttgctggagacactgaagtgtttgaagaaagatgatgaaagtaatttggtggaggagaaatcaaacatgatccggaagtcactggagatgttggagctcggcctgagtgaggcacaggttatgatggctttgtcaaatcacctgaatgctgtggagtccgagaagcagaaactgcgtgcgcaggttcgtcgtctgtgccaggagaatcagtggctacgggatgaactggccaacacgcagcagaaactgcagaagagtgagcagtctgtggctcaactggaggaggagaagaagcatctggagtttatgaatcagctaaaaaaatatgatgacgacatttccccatccgaggacaaagacactgattctaccaaagagcctctggatgaccttttccccaatgatgaagacgacccagggcaaggaatccagcagcagcacagcagtgcagccgcggctgcccagcagggcggctacgagatccccgcgcggctgcggacgctccacaacctggtgatccagtacgcctcgcaggggcgctacgaggtagctgtgcccctctgcaagcaggccctggaggacctggagaagacttcaggacacgaccacccggacgtggccaccatgctcaacatcctggccttggtgtacagggatcagaataaatacaaagatgcagctaacctactgaatgatgccttggctattcgtgagaaaactttgggcaaagatcatcctgcggtggcggcgactttgaataaccttgcagtcctttatggtaaaagagggaagtacaaagaagcagagccgttgtgtaaaagagctctggaaatccgagaaaaggttttggggaaggatcaccccgatgttgccaagcagttaaataacttggccttactgtgccagaaccagggcaagtatgaagaagtagaatattattatcaaagagccctcgagatctaccagacaaaactgggacctgatgaccccaacgtggctaagacgaaaaataacctggcatcctgctatttgaaacaaggaaagttcaagcaagcagaaacactgtacaaagagattctcactcgtgcacatgaaagggagtttggttctgtagatgatgaaaataaacccatctggatgcatgctgaagaaagagaagaatgcaaaggaaagcaaaaggatgggacatcttttggagagtatggcggctggtacaaagcctgcaaagttgatagtccaactgttacaaccactctaaaaaaccttggggcactttacagacgtcaaggcaaatttgaagctgcagaaacgttagaagaagctgctatgaggtctcgtaaacagggtcttgacaatgttcacaaacagagggtggcagaagtgctcaatgaccctgagaacatggagaagcgcaggagccgtgagagcctcaacgtggacgtggtcaagtacgagagtggccctgacggaggggaggaagtgagtatgagcgtagagtggaacgggatgaggaaaatgaagctcgggctggttaactga

SEQ ID NO: 16629 - DNA, 120 bp, Artificial Sequence
  Synthetic polypeptide
gggagctttcagaaatcctgatgtccagactgtaccctatcccgatgaaaccagaatcgctggggtgggccccaagcaccagccatttcttcaactctccaggtcagaaagcaacattga

SEQ ID NO: 16630 - DNA, 163 bp, Artificial Sequence
  Synthetic polypeptide
gggagctttcagaaatcctgatgtccagactgtaccctatcccgatgaaaccagaatcgctggggtgggccccaagcaccagccatttcttcaactctccaggtcagaaagcaacattgaatgcagaagaaatggcggacttctacaaggaatttttaagtaa

SEQ ID NO: 16631 - DNA, 1522 bp, Artificial Sequence
  Synthetic polypeptide
acattcccttgctttgtcagctgagagagtctagaagcaacaacacctcactagcaatgaacacaccagtgcctggatcttggtttctaacaccgttctaggaaaggagccagggcttcttggagaattgactgattcaagggcaaaggtgggacatgcagaagataagcctggagcatctttagtagcagaaattaaggagatgcccaaaaagccaagtgatgagcacctgtcagaggcacacaggagccgggaacccaccacgggagctcgccaaggccaacctcaaagaagctgagcaggaaaagaagcaaagtcacactggagtccagcccaagcatgggctgagtatccatgagtccgtagcaatataaataaaagattgagtacataagtaatgtggaggcatgaacgagtattcccacccccctccggaacatttcccagtcactcatgactggagtccagccctagcatgggctaaatatccatgagtccatagcaatataaatacaaggatgagtacataagtaacatggaggcatgaacgagtattccatcacctcctgcctccagaacatttcccagtcactcatgactggagtccagcctgagcatgggctaaatatccatgagtctgtagcaatataaataaaagattgagtacataagtaatgtggaggcctggaggagtatcccccccaggacatttcccagtcactcatgtagctacttctcctcggaagtggagcacaacctgtacccctaagtgtgggctgtgtatggcgatgtccttccagagaggacagcatggagagggggacttcacagtggggagacctcagccagccgaccacggccaccactgtcagtgaagagtcatgtcagcagtgtgtgtacccttgttatgacatgatgagaatggcatttacctgtgtggtcttcctccccaaacccataaccccaggctatttacgaggaaaacctcagacaaatcccaactgaggagtgtcctgcaatgcacctgaccagggctcctcaaaccatcaaggtcatcaacggcaagggccatctgagaccctgtcacagccaagaggagtccaaggagatatggcagcgaaatgtgatgaggtccttggcagaaatggaaaattgggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatga

SEQ ID NO: 16632 - DNA, 294 bp, Artificial Sequence; identical to SEQ ID NO: 6802
  Synthetic polypeptide

SEQ ID NO: 16633 - DNA, 737 bp, Artificial Sequence
  Synthetic polypeptide
cactttgggaggctgaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatag

SEQ ID NO: 16634 - DNA, 380 bp, Artificial Sequence; identical to SEQ ID NO: 682
  Synthetic polypeptide

SEQ ID NO: 16635 - DNA, 422 bp, Artificial Sequence; identical to SEQ ID NO: 683
  Synthetic polypeptide

SEQ ID NO: 16636 - DNA, 271 bp, Artificial Sequence; identical to SEQ ID NO: 684
  Synthetic polypeptide

SEQ ID NO: 16637 - DNA, 197 bp, Artificial Sequence; identical to SEQ ID NO: 685
  Synthetic polypeptide

SEQ ID NO: 16638 - DNA, 524 bp, Artificial Sequence; identical to SEQ ID NO: 686
  Synthetic polypeptide

SEQ ID NO: 16639 - DNA, 171 bp, Artificial Sequence
  Synthetic polypeptide
ttctgtctccttctgccaggtgaacacacagtgttcatcccctcaggaggacacagcttttgaggtaccatcttggaagcagagaccagacctcactagacacaaacttcctggcaccttgattttggacttcatagcctctagaactttattcagaggctgctctgctga

SEQ ID NO: 16640 - DNA, 1578 bp, Artificial Sequence
  Synthetic polypeptide
ggccgggcgtggtggctcacacctgtgatcccagcactttgggaggctgaggcgaatggatcacttgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactga

SEQ ID NO: 16641 - DNA, 1425 bp, Artificial Sequence
  Synthetic polypeptide
ggccgggcgtggtggctcacacctgtgatcccagcactttgggaggctgaggcgaatggatcacttgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtga

SEQ ID NO: 16642 - DNA, 97 bp, Artificial Sequence
  Synthetic polypeptide
ggccgggcgtggtggctcacacctgtgatcccagcactttgggaggctgaggcgaatggatcacttgaggaccaaccctcagagccccccagcccgg

SEQ ID NO: 16643 - DNA, 1259 bp, Artificial Sequence
  Synthetic polypeptide
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttga

SEQ ID NO: 16644 - DNA, 341 bp, Artificial Sequence
  Synthetic polypeptide
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaaggttgtttcttcaagtttctga

SEQ ID NO: 16645 - DNA, 665 bp, Artificial Sequence
  Synthetic polypeptide
tgtggaggctaaagcaatgccatcttggatgctaatctgccatgttgacttctgactaaccccagtcccaggaaggcttctaagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaa

SEQ ID NO: 16646 - DNA, 47 bp, Artificial Sequence
  Synthetic polypeptide
tgagaggtgaagccagctggacttctgggtggggattcctgagctga

SEQ ID NO: 16647 - DNA, 510 bp, Artificial Sequence
  Synthetic polypeptide
gagccacagcttatccagggttagatcacaaaggcaacaggccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16648 - DNA, 651 bp, Artificial Sequence
  Synthetic polypeptide
gagccacagcttatccagggttagatcacaaaggcaacaggccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16649 - DNA, 319 bp, Artificial Sequence; identical to SEQ ID NO: 13947
  Synthetic polypeptide

SEQ ID NO: 16650 - DNA, 310 bp, Artificial Sequence; identical to SEQ ID NO: 13948
  Synthetic polypeptide

SEQ ID NO: 16651 - DNA, 3565 bp, Artificial Sequence; identical to SEQ ID NO: 13949
  Synthetic polypeptide

SEQ ID NO: 16652 - DNA, 3544 bp, Artificial Sequence; identical to SEQ ID NO: 13950
  Synthetic polypeptide

SEQ ID NO: 16653 - DNA, 224 bp, Artificial Sequence; identical to SEQ ID NO: 13951
  Synthetic polypeptide

SEQ ID NO: 16654 - DNA, 159 bp, Artificial Sequence; identical to SEQ ID NO: 13952
  Synthetic polypeptide

SEQ ID NO: 16655 - DNA, 3508 bp, Artificial Sequence; identical to SEQ ID NO: 13953
  Synthetic polypeptide

SEQ ID NO: 16656 - DNA, 204 bp, Artificial Sequence; identical to SEQ ID NO: 13957
  Synthetic polypeptide

SEQ ID NO: 16657 - DNA, 473 bp, Artificial Sequence; identical to SEQ ID NO: 13576
  Synthetic polypeptide

SEQ ID NO: 16658 - DNA, 117 bp, Artificial Sequence
  Synthetic polypeptide
gagatggatctgagtcgtaatgaaatggtctccttcacagccggctgtgcgtgaactactctgtctcctgcagctcccctgtcttgataattggctgtctaggcagcgggagaatga

SEQ ID NO: 16659 - DNA, 319 bp, Artificial Sequence
  Synthetic polypeptide
gagatggatctgagtcgtaatgaaatggtctccttcacagccggctgtgcgtgaactactctgtctcctgcagctcccctgtcttgataattggctgtctaggcagcgggagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctag

SEQ ID NO: 16660 - DNA, 616 bp, Artificial Sequence
  Synthetic polypeptide
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagccctcagtaccgcctggagaagcagagcgagcccaatgtcgccgttgacctggacagcactttggagagccagagcgcatgggagttctgcctggtccgcgagaacagtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16661 - DNA, 757 bp, Artificial Sequence
  Synthetic polypeptide
ctgttactttttctagctctctgataagtttcttaacctgtttgaacttcgttttcctcatttatgaatgaaaataataataatgtcttcttcatagcattattgtgagaattaagcagcgatccttgcaaagcaccaaggacccagccctcagtaccgcctggagaagcagagcgagcccaatgtcgccgttgacctggacagcactttggagagccagagcgcatgggagttctgcctggtccgcgagaacagttcaagggcagacggggtttttgaggaggattcgcaaattgacatagccacagtacaggatatgcttagcagccaccattacaagtcattcaaagtcagcatgatccacagactgcgattcacaaccgacgtacagctaggtatctctggagacaaagtagagatagaccctgttacgaatcagaaagccagcactaagttttggattaagcagaaacccatctcaatcgattccgacctgctctgtgcctgtgaccttgctgaagagaaaagccccagtcacgcaatatttaaactcacgtatctaagcaatcacgactataaacacctctactttgaatcggacgctgctaccgtcaatgaaattgtgctcaaggttaactacatcctggaatcgcgagctagcactgcccgggctgactactttgctcaaaaacaaagaaaactgaacagacgtacgagcttcagcttccagaaggagaagaaatccgggcagcagtga

SEQ ID NO: 16662 - DNA, 2191 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16663 - DNA, 2536 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16664 - DNA, 1999 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16665 - DNA, 2629 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16666 - DNA, 2023 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16667 - DNA, 2104 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16668 - DNA, 1564 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagtcaacgaaggcttga

SEQ ID NO: 16669 - DNA, 2461 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16670 - DNA, 2266 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16671 - DNA, 2359 bp, Artificial Sequence
  Synthetic polypeptide
agaaggaagcaccccaagggcaggaagttcagtcagttttgtcgatatattccgcatgtctgcaatacgacaggcatagagagtgttcaaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacgtcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaa

SEQ ID NO: 16672 - DNA, 850 bp, Artificial Sequence
  Synthetic polypeptide
cagttgactcttgaacaacatgggactgtaggggtccacttagagttttttctaatacattggaaaattttttggagatttgcagcaattggaaaaaactcacagatgaactgtatagcctagaaatatatttttttaattaagaagagttaggcatgtcttgaatgtgtaaaacatgtgtagatacttgtgtattttatcatttactaccacagaatatgcacaaatctattataaaaaattaaaattttatcaaaacttgcctatacaatatgcagatcatacatgaagccattcatagtcaagagaaatgtaaacaaatgtaaagatgcagtattaagtgagagtggcaaaaagttactgtggtatatactatacttctctaataatttcatagccacctcctattgctattgcagtgagttcaggtgctgcaagtatccacttaaaatgccacacattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtgatactggaagtgctcccaagaagaagagaaaagtctgacattacaagaaaaagttgaattgcttgggtttgaatgccggtgtggaaatgtttactgtggtgtacaccgttactcagatgtacacaattgctcttacaattacaaagccgatgctgctgagaaaatcagaaaagaaaatccagtagttgttggtgaaaagatccaaaagatttga

SEQ ID NO: 16673 - DNA, 782 bp, Artificial Sequence
  Synthetic polypeptide
cagttgactcttgaacaacatgggactgtaggggtccacttagagttttttctaatacattggaaaattttttggagatttgcagcaattggaaaaaactcacagatgaactgtatagcctagaaatatatttttttaattaagaagagttaggcatgtcttgaatgtgtaaaacatgtgtagatacttgtgtattttatcatttactaccacagaatatgcacaaatctattataaaaaattaaaattttatcaaaacttgcctatacaatatgcagatcatacatgaagccattcatagtcaagagaaatgtaaacaaatgtaaagatgcagtattaagtgagagtggcaaaaagttactgtggtatatactatacttctctaataatttcatagccacctcctattgctattgcagtgagttcaggtgctgcaagtatccacttaaaatgccacacattttaatcggcactgatcacctctgtttcagcagtttgtctctgtagtaaattgcctaccacagtaaaaggtaatctcttgtggttctcatgtatttttcatcgtgtttaatgcaatactgtaaactttgaataataccataagactcgtataaagtgatgccactagcactagtgatactggaagtgctcccaagaagaagagaaaagtctgacattacaagaaaaagttgaattgcttgggtttgaatgccggtgtggaaatgtttactgtggtgtacaccgttactcagatgtacacaattgctcttacaattacaaag

SEQ ID NO: 16674 - DNA, 1651 bp, Artificial Sequence
  Synthetic polypeptide
cagaagggaagcaaagtgctgtggcaaattgtgtgctgagctgggatccaggagttctggaccttcatcttggctctgccactaattagctgtgtccttggtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagagctctgcctattgaccgtccgaacaccttggataagtggtttctgattttgagaggacagcagagggctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgaggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggcttaagcgcagtggggatttttacccttgaatactccgtgcagcgagtgcgtcagctccgtgaagaatttgatcaaggtctggatgtagtgctggatgacaatcagaatgtgcatgatgtggctgcactcctcaaggagtttttccgtgacatgaaggattctctgctgccagatgatctgtacatgtcattcctcctgacagcaactttaaagccccaggatcagctttctgccctgcagttgctggtctacctgatgccaccctgccacagtgataccctggagcgtctgctgaaggccctgcataaaatcactgagaactgcgaggactcaattggcattgatggacagttggtcccaggcaaccgtatgacttccactaacttggccttggtgtttggatctgctctcctgaaaaaaggaaagtttggcaagagagagtccaggaaaacaaagctggggattgatcactatgttgcttctgtcaatgtggtccgtgccatgattgataactgggatgtcctcttccaggtgcctccccatattcagaggcaggttgctaagcgcgtgtggaagtccagcccggaagcacttgattttatcagacgcaggaacttgaggaagatccagagtgcacgcataaagatggaagaggatgcactactttctgatccagtggaaacctctgctgaagcccgggctgctgtccttgctcaaagcaagccttctgatgaaggttcctctgaggagccagctgtgccttccggcactgcccgttcccatgacgatgaggaaggagcgggtaaccctcccattccggagcaagaccgcccattgctccgtgtgccccgggagaaggaggccaaaactggcgtcagctacttctttccttag

SEQ ID NO: 16675 - DNA, 1443 bp, Artificial Sequence; identical to SEQ ID NO: 6760
  Synthetic polypeptide

SEQ ID NO: 16676 - DNA, 984 bp, Artificial Sequence; identical to SEQ ID NO: 6761
  Synthetic polypeptide

SEQ ID NO: 16677 - DNA, 1032 bp, Artificial Sequence; identical to SEQ ID NO: 6762
  Synthetic polypeptide

SEQ ID NO: 16678 - DNA, 1742 bp, Artificial Sequence
  Synthetic polypeptide
gcggaagatccaggctgagagtggagacaaacaactgtggctctcattccaggctcactgtttactccgtgaccttgaccaagtctctaaatggaactctccgcccagttcgccgcaactactacgacccctcctcggcccctgggaagggcgtggtgtgggagtgggagaacgacaatggctcctggacgccctacgacatggaagtgggcatcaccatccagcatgcctatgagaagcagcacccctggatcgacctcacttccattggctttagctacgtaattgacttcaacaccatgggccagatcaaccgtcagacccagcgccaacgccgcgtccgccggcgcctcgacctcatctaccccatggtcacagggaccttgcctaaggctcagtcctggccagtcagccctgggccagccacctcgccccccatgtccccctgctcctgtccccagtgtgtcttggtgatgagtgttaaggcagccgtggtcaatggcagcactgggcccctacagctgccagtgacccgcaagaacatgccgcctcctggagtggtcaagctacccccactgccaggctctggggccaagccactggacagcacaggcaccattcgaggcccactgaagaccgccccatcgcaggtgatccggagacaagcctccagcatgcccactgggacaaccatgggctctcctgccagtcccccaggacccaacagcaagaccggaagggtggccctggccaccttgaatcgtaccaacctgcagcgactggccattgcccagtcccgggtgctgatcgcctctggggtccccacagtcccagtgaagaacctaaatgggtccagtcctgtcaaccctgccttggcaggaatcactgggatcctcatgagtgcagcggggctgcctgtgtgtctcaccaggccaccaaagctggtcctacacccaccccccgtcagcaagagtgaaataaaatccatcccaggggtttccaacacaagccgcaagaccaccaaaaaacaagccaagaaaggtaaaaccccagaggaagtgctaaaaaaatatctacagaaagtccggcacccaccagatgaggactgcaccatctgtatggaacgcctcacggccccctcaggctacaagggcccgcagcctacggtaaaacctgacctggtagggaagctgtccagatgcggccacgtctaccacatctactgcttggttgccatgtacaacaatgggaacaaggatggaagtttgcagtgtccaacctgcaagaccatttatggggtgaagacaggcacccaacctccagggaagatggagtaccacctcatcccccactccttgcctggccacccagactgcaaaaccatccggatcatctacagcatcccccccggcattcagggaccggaacacccgaatcctgggaagagtttcagcgcccgaggcttcccacgacactgttaccttccggacagcgagaaagggagaaaagttctgaagctgctgctcgtggcctgggatcgccgcctcatttttgccattggcacctccagcaccacaggcgagtcagacaccgtcatctggaatgaggtccaccacaagacagagtttggctctaatctcactggccatggctacccagatgccaattacctggataatgtgctggctgaactggctgcccagggcatctctgaggacagcactgcccaggagaaggactga

SEQ ID NO: 16679 - DNA, 1392 bp, Artificial Sequence; identical to SEQ ID NO: 6782
  Synthetic polypeptide

SEQ ID NO: 16680 - DNA, 933 bp, Artificial Sequence; identical to SEQ ID NO: 6783
  Synthetic polypeptide

SEQ ID NO: 16681 - DNA, 981 bp, Artificial Sequence; identical to SEQ ID NO: 6784
  Synthetic polypeptide

SEQ ID NO: 16682 - DNA, 846 bp, Artificial Sequence; identical to SEQ ID NO: 7174
  Synthetic polypeptide

SEQ ID NO: 16683 - DNA, 506 bp, Artificial Sequence; identical to SEQ ID NO: 7175
  Synthetic polypeptide

SEQ ID NO: 16684 - DNA, 672 bp, Artificial Sequence; identical to SEQ ID NO: 7176
  Synthetic polypeptide

SEQ ID NO: 16685 - DNA, 708 bp, Artificial Sequence; identical to SEQ ID NO: 7177
  Synthetic polypeptide

SEQ ID NO: 16686 - DNA, 298 bp, Artificial Sequence
  Synthetic polypeptide
gtgtgaccgctggcctctgcacggagaacatttccgcctagaaatcttcgagggttgcaacttcacgggccagtgcctggagttcctggaggacagccccttcctccagagcaggggctgggtcaagaactgtgtgaacaccatcaaggtgtacggggacggagcagcatggagccctagaagcttcggagctgaggacttccagctgagcagctctcttcaatcagatcaaggaccggaagaggccaccacaaaaccagcaacaacccagccacctttcctgactgcaaacctctga

SEQ ID NO: 16687 - DNA, 1410 bp, Artificial Sequence
  Synthetic polypeptide
ggctaatagtgttggttctggagcctggaggcctaggtgcaaatactggcttcgctacttactagtggagtgaccttggacaaggggcttccctccacacttcagtttccctaataggaaactgaacatacctatgtgatggggtattgtaaagacgcaatgaatcaacattgaaagcatttagcacagtgcttggcatttggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctag

SEQ ID NO: 16688 - DNA, 362 bp, Artificial Sequence; identical to SEQ ID NO: 827
  Synthetic polypeptide

SEQ ID NO: 16689 - DNA, 830 bp, Artificial Sequence
  Synthetic polypeptide
atggaggatagatggctgatagaagaaaggatggataaacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16690 - DNA, 495 bp, Artificial Sequence; identical to SEQ ID NO: 7842
  Synthetic polypeptide

SEQ ID NO: 16691 - DNA, 373 bp, Artificial Sequence; identical to SEQ ID NO: 7843
  Synthetic polypeptide

SEQ ID NO: 16692 - DNA, 158 bp, Artificial Sequence
  Synthetic polypeptide
ttccagtccatattctgccgctaactagttgtggactttgggaatacatgcaccacctgctcgccctggagcatcgcgctgaggagcagttcctggagcactggctgaaccctcactgcaaaccccactgtgacaggaacaggattcatcctgtgtaa

SEQ ID NO: 16693 - DNA, 595 bp, Artificial Sequence
  Synthetic polypeptide
tgatatggtttggctgtgtcccagatctcatcttgaattcccatgtgttgtaggagagacacagtgggaggtaatggaatcacggaggcaggtctttcctgtgctgctcttgtgatagtgaataagtctcacgagatctgatggttttaaaaaggggagtttctctgcacaagctctctctttgcctgccaccatcagtgtaagatgtgacttgcttctccttgtcttctgccacgattgtgaggcctccccaaccacatggaactgtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtga

SEQ ID NO: 16694 - DNA, 525 bp, Artificial Sequence
  Synthetic polypeptide
tgatatggtttggctgtgtcccagatctcatcttgaattcccatgtgttgtaggagagacacagtgggaggtaatggaatcacggaggcaggtctttcctgtgctgctcttgtgatagtgaataagtctcacgagatctgatggttttaaaaaggggagtttctctgcacaagctctctctttgcctgccaccatcagtgtaagatgtgacttgcttctccttgtcttctgccacgattgtgaggcctccccaaccacatggaactgtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaa

SEQ ID NO: 16695 - DNA, 1278 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttga

SEQ ID NO: 16696 - DNA, 399 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactgtggaacttgaattga

SEQ ID NO: 16697 - DNA, 1071 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagacaactgttagttttgtggcttactgctgctccacccagtgtctgcagacttttgacctgctgagttga

SEQ ID NO: 16698 - DNA, 630 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagtacctcactgtggaccgaaatcgtctatggtatgtgccgcgccatctctgccagctgcccagcctcaatga

SEQ ID NO: 16699 - DNA, 1113 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaaggaagacaactgttagttttgtggcttactgctgctccacccagtgtctgcagacttttgacctgctga

SEQ ID NO: 16700 - DNA, 1211 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatggtatgtgccgcgccatctctgccagctgcccagcctcaatgagctctccatggctggaaaccgtcttgcatttttgccacttgatttaggtcgatctcgagaactacagtatgtatacgtggataacaacattcacctgaaaggcttgccatcttatctgtacaataaagtcatcgggtgcagtggctgtggtgctcccattcaagtttccgaggtgaagctgctttccttttcatcagggcagcgaaccgttttcctcccagctgaggtgaaggccatagggacggagcatgatcacgtcctccctctgcaggaattggctatgagagggctgtatcatacctaccacagcttgctgaaagatttgaactttctgtctccaatctcattacccagaagtctcctagagctgctgcactgccctctggggcactgtcatcggtgtagtgagcctatgtttaccatcgtctaccccaagctctttcccttgagagagacgccaatggcagggctgcaccagtggaagac

SEQ ID NO: 16701 - DNA, 456 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactgaagacaactgttagttttgtggcttactgctgctccacccagtgtctgcagacttttgacctgctgagttga

SEQ ID NO: 16702 - DNA, 684 bp, Artificial Sequence
  Synthetic polypeptide
caggggtccccaatccctgggccacagacctggtacctgttaggaacggggccgcacagcaggaggtgagtggcaggcaagcaagcgaagcttcatctgtatttatagccactccctgtggcttgcattaccgcttgaatgccacctcctgtcccatcagcagcagcattagattctcatagcacaaaccctattgtgaactgcacatgtgagtgatctagtttgtgcacttgttatgagaatctagtgcctgacgatctgtcacagtctcccgtcacccccagatgggaccatctagttgcaggaaaacaagctcagggttcccactgattcttcattatgccagaaaaccttgctcagaagcttccaaaccttgtggaactatacctgcactcaaataacatagttgtggttccggaagccattgggtctcttgtaaaactccaatgtctggatcttagtgacaatgccttagaaattgtttgcccagaaattggtcgtctgagagctttacgtcatcttcgattagctaataaccaactgcaattcctacctccagaggttggcgatttgaaggagctgcagacactagacatttctaccaatcgtttgctaactttacccgagaggcttcacatgtgcctttctctgcagtacctcactgtggaccgaaatcgtctatgg

SEQ ID NO: 16703 - DNA, 527 bp, Artificial Sequence
  Synthetic polypeptide
ggctgggctctgtggctcatgcctgtaatcccagcactttgggaggccaaggcaggaggatctcttgacaggagcccaaggtcaggagttcaagcttgaccaatgaggtggtccatatgtgtcccaccattggcagcaacgtggaggagatcattctgccgaagacccacttcttcatgtgggacatagtgagacctgaggctctgagctttatctggaacacatactactccaacactgagtttatcatccttgtgattgacagcacggaccgggatcggctgctgaccactcgggaggagctatataaaatgctggcccatgaggctctacaggatgcttcagtcctgatatttgccaataagcaggacgtgaaggactccatgaggatggtggagatctcccatttccttactctcagcaccatcaaagaccactcgtggcatatacaaggctgctgtgccctcaccagggaagggctgcctgccagacttcagtggatggaatctcaggccgctgctaactga

SEQ ID NO: 16704 - DNA, 1075 bp, Artificial Sequence
  Synthetic polypeptide
gtgagcgagtaggggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctga

SEQ ID NO: 16705 - DNA, 205 bp, Artificial Sequence
  Synthetic polypeptide
gtgagcgagtaggggccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcccagtga

SEQ ID NO: 16706 - DNA, 803 bp, Artificial Sequence
  Synthetic polypeptide
catatgtgtgtagagaaaagactggaggaatagacaacaaaacatgaacagtgcttggccctttaaaaaagccttggatggaaattcttattttcttctctgttcgagaacttgtcttggacaattgcaaatcaaatgatggaaaaattgagggcttaacagctgaatttgtgaacttagagttcctcagtttaataaatgtaggcttgatctcagtttcaaatctccccaagctgcctaaattgaaaaagcttgaactcagtgaaaatagaatctttggaggtctggacatgttagctgaaaaacttccaaatctcacacatctaaacttaagtggaaataaactgaaagatatcagcaccttggaacctttgaaaaagttagaatgtctgaaaagcctggacctctttaactgtgaggttaccaacctgaatgactaccgagagagtgtcttcaagctcctgccccagcttacctacttggatggctatgaccgagaggaccaggaagcacctgactcagatgccgaggtggatggtgtggatgaagaggaggaggacgaagaaggagaagatgaggaagacgaggacgatgaggatggtgaagaagaggagtttgatgaagaagatgatgaagatgaagatgtagaaggggatgaggacgacgatgaagtcagtgaggaggaagaagaatttggacttgatgaagaagatgaagatgaggatgaggatgaagaggaggaagaaggtgggaaaggtgaaaagaggaagagagaaacagatgatgaaggagaagatgattaa

SEQ ID NO: 16707 - DNA, 497 bp, Artificial Sequence
  Synthetic polypeptide
ctcaaactgtgacccatgaaccagtaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattga

SEQ ID NO: 16708 - DNA, 386 bp, Artificial Sequence
  Synthetic polypeptide
atctggtttctggctatatctcctgtattatttttcagcagtattccccttgaactttaagttattaccatggtgaactgctgtatttcgtgaacaagccttgttccctgtcaccttggggaatttgcaaatacttttccggatgcctggaacacaggtcccactacctaccttccatctgtgctgctttgcctggctaactgctgcttaccacccagatctgcttagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataa

SEQ ID NO: 16709 - DNA, 309 bp, Artificial Sequence; identical to SEQ ID NO: 7876
  Synthetic polypeptide

SEQ ID NO: 16710 - DNA, 699 bp, Artificial Sequence
  Synthetic polypeptide
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcacctgtgagaatcccagatgtcctttctcccagctcccagcactgccctcccagctagacctatgtgagcaggtgtttgggctctcagccttgtcagtagcccaggctgtggctcagacgaactcctactacggtggccagacccctggggctaacaaagtgctgtttgttaatggggacacagacccctggcatgtgctaagtgtaacacaggctttaggatcctcagaatcaactcttcttatccgcactggctcccactgcttggacatggcacctgagaggccctcagactcccccagcctccgcctagggcgccagaacatcttccagcagctacagacctggctcaagctggcaaaggagagccagattaagggtgaagtctga

SEQ ID NO: 16711 - DNA, 367 bp, Artificial Sequence
  Synthetic polypeptide
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcacctgtgagaatcccagatgtcctttctcccagctcccagcactgccctcccagctag

SEQ ID NO: 16712 - DNA, 311 bp, Artificial Sequence
  Synthetic polypeptide
aatacattagtcttcctaacatcttaggaactttgtacatgctgttcactttgcttggattattcatcttcaagtctcaatagggtggcctccctcaggaagccatgatccctcaagataagtcagccttgccacctccgacttcgatagctctgtgttctccttagcattttacacagcctgtcataatacattttttattgcctgtcttcccctctggactgagtcctgtgacagcagagcctggagctgtcttggttgccaccatgtgcccaacattgtacaacatttatctgagcacctgatgtcac

SEQ ID NO: 16713 - DNA, 772 bp, Artificial Sequence
  Synthetic polypeptide
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16714 - DNA, 602 bp, Artificial Sequence
  Synthetic polypeptide
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctga

SEQ ID NO: 16715 - DNA, 721 bp, Artificial Sequence
  Synthetic polypeptide
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaacaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16716 - DNA, 748 bp, Artificial Sequence
  Synthetic polypeptide
cagaaagcagcgcagagcagcgcacagcagcgcacgacaaacagatccgactggaagctgcctcttagaccatgtgagcctgtgaccccggcccacaactcaacttctggcctcagtgtgttcaacggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatag

SEQ ID NO: 16717 - DNA, 80 bp, Artificial Sequence; identical to SEQ ID NO: 6364
  Synthetic polypeptide

SEQ ID NO: 16718 - DNA, 217 bp, Artificial Sequence; identical to SEQ ID NO: 6365
  Synthetic polypeptide

SEQ ID NO: 16719 - DNA, 1721 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagtgttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 16720 - DNA, 1835 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggcttgaaggccattgcgaggatttgccagactgttggtgtgaaagcaggagccccagacgaagctgtgtgcggagagaatgtttcccagatttactgtgcgctgctgggctgcatggacgactacaccacggacagcagaggggacgtgggcacctgggtccgcaaggccgccatgaccagtctgatggatctgacacttctgctggctcggagccagcctgagctgatcgaggcccatacctgtgagcgcatcatgtgctgtgtggcccagcaggccagtgagaagattgaccgtttccgtgctcacgccgccagcgtgttcctgacgctcctgcactttgacagccctcccatcccccacgtgccccaccgaggagaactggaaaagctgtttcccaggtccgatgtggcctccgtgaactggagtgcaccttcccaggccttcccacgcatcacccagctccttgggctgcccacctaccgctaccacgtcctgctggggctagtcgtgtccctgggcggcttgacggagtcgacgatccggcactccacccagagcctctttgagtacatgaagggcattcagagcgacccgcaggccctgggcagcttcagcgggacccttctgcagatctttgaggacaaccttctgaatgagagggtgtccgtgccgctgctgaagacgctggaccacgtgctcacccacggctgcttcgacatcttcaccacggaggaggaccacccctttgctgtgaagttgcttgcgctctgtaagaaagaaatcaagaattcaaaagatatccagaagctcctgtcaggcatcgcagttgactttccaagtgcgacactcgtgtgtgtaggcacagtgcagatgtacgcacacacacacctccggcttggggccccaggcccgcactgtgctcacggatctgctctgcccaggttctgcgagatggtgcagttccccggcgacgtgaggaggcaggccctcctgcagctgtgtctgctcctctgccaccgtttcccgctgatccggaagaccacggccagccaggtgtacgagacattgctcacctacagtgacgtcgtgggcgcggatgtgctggacgaggtggtgactgtgctcagtgacactgcgtgggacgcggagcttgcagtggtgagagagcagcgcaaccgtctgtgtgaccttctgggcgtacccaggccccagctggtgccccagcctggtgcctgctga

SEQ ID NO: 16721 - DNA, 253 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggca

SEQ ID NO: 16722 - DNA, 319 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaa

SEQ ID NO: 16723 - DNA, 231 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtg

SEQ ID NO: 16724 - DNA, 338 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagacttggtcattgtccctcagatgcctccagagcacacggtgcaggggtgtcacctttccgacgtacccatgggtgcccggagttgcctccttagtgggatcaagaccatcccccacatgtcatggacagctggtgacctggtcgctcttggtgtttga

SEQ ID NO: 16725 - DNA, 598 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccgaggacgtaagttttgctgagtccaggagagacggctt

SEQ ID NO: 16726 - DNA, 156 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgg

SEQ ID NO: 16727 - DNA, 520 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagca

SEQ ID NO: 16728 - DNA, 318 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatga

SEQ ID NO: 16729 - DNA, 561 bp, Artificial Sequence
  Synthetic polypeptide
ggggtctgatgtctcctgaaagtaaagcagaattttgtgtgtgcgtctgtcggatttctctggggagacagtgtgttcatctttctgggctttgagagattctcaaaggcttctgtgacccagagctctatgatcgtcagttatacaggggtctgggaggacagctcatgagacaagcagtgtgtgttttaatagaaaagttgtcactttccaaaatgccctttagaggtgacaccgtaattgatggttggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggccttgggcgcccttccaggcttccttctgaaaggccggctccagcaggttctcacaggtttaagagcagttacccacacttcccccg

SEQ ID NO: 16730 - DNA, 337 bp, Artificial Sequence; identical to SEQ ID NO: 6393
  Synthetic polypeptide

SEQ ID NO: 16731 - DNA, 2333 bp, Artificial Sequence; identical to SEQ ID NO: 7950
  Synthetic polypeptide

SEQ ID NO: 16732 - DNA, 1267 bp, Artificial Sequence; identical to SEQ ID NO: 463
  Synthetic polypeptide

SEQ ID NO: 16733 - DNA, 665 bp, Artificial Sequence; identical to SEQ ID NO: 6374
  Synthetic polypeptide

SEQ ID NO: 16734 - DNA, 518 bp, Artificial Sequence; identical to SEQ ID NO: 6375
  Synthetic polypeptide

SEQ ID NO: 16735 - DNA, 1057 bp, Artificial Sequence
  Synthetic polypeptide
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16736 - DNA, 1066 bp, Artificial Sequence
  Synthetic polypeptide
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16737 - DNA, 1087 bp, Artificial Sequence
  Synthetic polypeptide
agggtggcggggctgagccagggctccgagggtagatggcctggattgggccccaggctacacctctcactggctagagcagctggctgctgccaaggcccaacaggagcaggagctggcggctgatgccttcaaggagctggatgatgacatggacgggacggtctcggtgactgagctgcagactcacccggagctggacacagatggggatggggcgttgtcagaagcggaagctcaggccctcctcagtggggacacacagacagacgccacctctttctacgaccgcgtctgggccgccatcagggacaagtaccggtccgaggcactgcccaccgaccttccagcaccttctgcccctgacttgacggagcccaaggaggagcagccgccagtgccctcgtcgcccacagaggaggaggaggaggaggaggaggaggaggaagaagaggctgaagaagaggaggaggaggaggattccgaggtgcagggggagcagcccaaggaggccccaccgccactgtcacccccgcagccggccagccctgctgaggaagacaaaatgccgccctacgacgagcagacgcaggccttcatcgatgctgcccaggaggcccgcaacaagttcgaggaggccgagcggtcgctgaaggacatggaggagtccatcaggaacctggagcaagagatttcttttgactttggccccaacggggagtttgcttacctgtacagccagtgctacgagctcaccaccaacgaatacgtctaccgcctctgccccttcaagcttgtctcgcagaaacccaaactcgggggctctcccaccagccttggcacctggggctcatggattggccccgaccacgacaagttcagtgccatgaagtatgagcaaggcacgggctgctggcagggccccaaccgctccaccaccgtgcgcctcctgtgcgggaaagagaccatggtgaccagcaccacagagcccagtcgctgcgagtacctcatggagctgatgacgccagccgcctgcccggagccaccgcctgaagcacccaccgaagacgaccatgacgagctctag

SEQ ID NO: 16738 - DNA, 169 bp, Artificial Sequence
  Synthetic polypeptide
ggccgggcgcggtggctcatgcctgtaatcccagcactttgggaggcagaggcgggcggattcccagggccaagaccagcttcaagtctccatggtaccagaaaacaacaacctcacagcacctgaacctcaagaagaggtatccacaagtgaaaatccacaactctga

SEQ ID NO: 16739 - DNA, 742 bp, Artificial Sequence; identical to SEQ ID NO: 6357
  Synthetic polypeptide

SEQ ID NO: 16740 - DNA, 590 bp, Artificial Sequence; identical to SEQ ID NO: 6358
  Synthetic polypeptide

SEQ ID NO: 16741 - DNA, 577 bp, Artificial Sequence; identical to SEQ ID NO: 6359
  Synthetic polypeptide

SEQ ID NO: 16742 - DNA, 430 bp, Artificial Sequence; identical to SEQ ID NO: 6360
  Synthetic polypeptide

SEQ ID NO: 16743 - DNA, 670 bp, Artificial Sequence; identical to SEQ ID NO: 6361
  Synthetic polypeptide

SEQ ID NO: 16744 - DNA, 712 bp, Artificial Sequence
  Synthetic polypeptide
atggaggatagatggctgatagaagaaaggatggataaacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16745 - DNA, 1350 bp, Artificial Sequence
  Synthetic polypeptide
cttagcataaaaatacataatttgcttctttgggtcttgatttctgaaggctccaatgtcacgtaaaactttggttagatgaatttgtgttgcttttctcttgttactctctctcttgttctaggggtatcagccatgacctctgcaatgggtgaggaaaagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacccaaaggaaagactaagacatctcgagatctggcgtgttttatacagtttgaaaatgtcaacatttactatgggactcagcataaaatgaaatataaagcgcccactgactattgctttgttttaaagcacccccaaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgccccctccggtgcggaggtcctccgacaccagcggcagtcccgccacgcccctcaaggccaagggcacaggcggcgggggcttgcccgccccacccgacgacttcctgccgccgccgccaccgccgccgcccctcgatgaccctgagctcccgccgccgcccccggacttcatggagccgcccccagacttcgtgcccccgcccccgccgtcgtacgcagggatcgcgggctcagagctgcccccgccgccgccgccgccgcccgcgcccgcgcccgcccccgtccccgactccgccaggccgccccccgcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctag

SEQ ID NO: 16746 - DNA, 243 bp, Artificial Sequence; identical to SEQ ID NO: 6494
  Synthetic polypeptide

SEQ ID NO: 16747 - DNA, 369 bp, Artificial Sequence; identical to SEQ ID NO: 6492
  Synthetic polypeptide

SEQ ID NO: 16748 - DNA, 1232 bp, Artificial Sequence; identical to SEQ ID NO: 6566
  Synthetic polypeptide

SEQ ID NO: 16749 - DNA, 497 bp, Artificial Sequence; identical to SEQ ID NO: 6567
  Synthetic polypeptide

SEQ ID NO: 16750 - DNA, 575 bp, Artificial Sequence; identical to SEQ ID NO: 6568
  Synthetic polypeptide

SEQ ID NO: 16751 - DNA, 1926 bp, Artificial Sequence; identical to SEQ ID NO: 7679
  Synthetic polypeptide

SEQ ID NO: 16752 - DNA, 477 bp, Artificial Sequence; identical to SEQ ID NO: 7680
  Synthetic polypeptide

SEQ ID NO: 16753 - DNA, 711 bp, Artificial Sequence; identical to SEQ ID NO: 7681
  Synthetic polypeptide

SEQ ID NO: 16754 - DNA, 288 bp, Artificial Sequence; identical to SEQ ID NO: 7682
  Synthetic polypeptide

SEQ ID NO: 16755 - DNA, 237 bp, Artificial Sequence; identical to SEQ ID NO: 7683
  Synthetic polypeptide

SEQ ID NO: 16756 - DNA, 703 bp, Artificial Sequence; identical to SEQ ID NO: 7684
  Synthetic polypeptide

SEQ ID NO: 16757 - DNA, 330 bp, Artificial Sequence; identical to SEQ ID NO: 6490
  Synthetic polypeptide

SEQ ID NO: 16758 - DNA, 355 bp, Artificial Sequence
  Synthetic polypeptide
gctgggcgcggtggctcatgcctgtcatcccagcattttgggaggccgaggtgggcgaatcacctgaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 16759 - DNA, 637 bp, Artificial Sequence
  Synthetic polypeptide
cagagtggacaggcagaggcccggcttctcattcctgctcacaactaactcactgcagcactcaggacaactcagctaagctgtctggaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctggtcctggagctcctgtgtcggatcctggaaacagacttgctaagcgcaatccagttctggctgctctacgctccgcccaaggaaaaagacctcgctctgggactcctgcagacagcagtggctcagctccttccccagcccctagtctccatccctacagaaaagctcctaagccagcttccagaagtgcatgaacctcctcaagagaagcaagagccaccctgcagtcaatccccgaagaaaacgaagatatcaccttttacaaaaagcgaaaaaccagagtacattggagaagctcaagtcctccagatgcattcaagccagaacacagagaagaagacatcgaagccgagggcagagagctga

SEQ ID NO: 16760 - DNA, 334 bp, Artificial Sequence
  Synthetic polypeptide
cagagtggacaggcagaggcccggcttctcattcctgctcacaactaactcactgcagcactcaggacaactcagctaagctgtctggaaggagcagaaggaggagcctctgcgggagcagggggcaaagtactcagcagagactgggaggctcatccccgcttccacccgggctgtcggccgccgcagatctcaccagggccagcagagtcagtcttccagcagacatgaaggagtccaggctttcctccttcaggatcaggagctgctgaaaaagacctcgctctgggactcctgcagacagcagtggctcagctccttccccagcccctag

SEQ ID NO: 16761 - DNA, 158 bp, Artificial Sequence; identical to SEQ ID NO: 7602
  Synthetic polypeptide

SEQ ID NO: 16762 - DNA, 1047 bp, Artificial Sequence; identical to SEQ ID NO: 8738
  Synthetic polypeptide

SEQ ID NO: 16763 - DNA, 1883 bp, Artificial Sequence; identical to SEQ ID NO: 6345
  Synthetic polypeptide

SEQ ID NO: 16764 - DNA, 348 bp, Artificial Sequence
  Synthetic polypeptide
tggtgtcagagtaggatttgaaagagaccccctgtggcctctggaagcatcgaggaaccaggcaaaaggtgtccattgtgctcactgctttctcgctgcatctggaggtcctgggaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatga

SEQ ID NO: 16765 - DNA, 1848 bp, Artificial Sequence; identical to SEQ ID NO: 7940
  Synthetic polypeptide

SEQ ID NO: 16766 - DNA, 1767 bp, Artificial Sequence; identical to SEQ ID NO: 7857
  Synthetic polypeptide

SEQ ID NO: 16767 - DNA, 1764 bp, Artificial Sequence; identical to SEQ ID NO: 7858
  Synthetic polypeptide

SEQ ID NO: 16768 - DNA, 630 bp, Artificial Sequence; identical to SEQ ID NO: 7859
  Synthetic polypeptide

SEQ ID NO: 16769 - DNA, 396 bp, Artificial Sequence
  Synthetic polypeptide
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacaactaagattacatccactggagaaatgttccagaatggactactga

SEQ ID NO: 16770 - DNA, 462 bp, Artificial Sequence
  Synthetic polypeptide
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacagcctcaaggggaaggtatatcaggaacctttgtcccccaatgcctgcatggatactacagcaatactacaacctcacagaagctgcttaacccatggatcctgaaaacatag

SEQ ID NO: 16771 - DNA, 363 bp, Artificial Sequence
  Synthetic polypeptide
gccaggcacggtggctcacacctgtaatcccagcactttgggaggccaaggcaggtggatcacataaggtcaggagctcgagaccagcctggccaacatggtgaaaacccatctctactaaaaacacaaaaatcagccaggtgtggtgacagatgcctgtaatcccagctactaaggaggctgagaaaggagaatcgcttgaacccaggaggcagaggttgcggcccactttgtagccccatcacccttggcctgctggtggctggcgtcctggttctgctggtttccctgggagtggccatccacctgtgctgccggcggaggagagcccggcttcgtttcatgaaacaattttacaaatga

SEQ ID NO: 16772 - DNA, 148 bp, Artificial Sequence; identical to SEQ ID NO: 6388
  Synthetic polypeptide

SEQ ID NO: 16773 - DNA, 1100 bp, Artificial Sequence; identical to SEQ ID NO: 6389
  Synthetic polypeptide

SEQ ID NO: 16774 - DNA, 464 bp, Artificial Sequence; identical to SEQ ID NO: 6390
  Synthetic polypeptide

SEQ ID NO: 16775 - DNA, 280 bp, Artificial Sequence; identical to SEQ ID NO: 6391
  Synthetic polypeptide

SEQ ID NO: 16776 - DNA, 387 bp, Artificial Sequence
  Synthetic polypeptide
ggccgggcgcggtggcttactcctgtaatcccagcactttgggaagctgaggtgggcgaatcacgaggtcaggagatggagaccatcctgactaacatgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatcaggcttccagacatcattgcttgtgccaagcagaacatcaccacggcagaaatcagcgcccgtgaaggcactggcttagcaggggtgctggcctggctccaggccacccacagagccaacgattga

SEQ ID NO: 16777 - DNA, 238 bp, Artificial Sequence; identical to SEQ ID NO: 6378
  Synthetic polypeptide

SEQ ID NO: 16778 - DNA, 337 bp, Artificial Sequence
  Synthetic polypeptide
gctgggcgcggtggctcatgcctgtcatcccagcattttgggaggccgaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 16779 - DNA, 812 bp, Artificial Sequence
  Synthetic polypeptide
atagacaagtggatggaaggagaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16780 - DNA, 441 bp, Artificial Sequence
  Synthetic polypeptide
gaagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 16781 - DNA, 438 bp, Artificial Sequence
  Synthetic polypeptide
gaagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 16782 - DNA, 443 bp, Artificial Sequence
  Synthetic polypeptide
ctcagataagccatgccacctctcctgacctctgtgtcctcatggggaaagtggggctaacaggaaaatgccctttgctgcatgtccaggggattaaggaaatgggatccctccaagcaggtgcctgcagcccagtgggcgcttaataactgatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgcttcttaaagtctgacttgtttttaaaacacaagcgaaccgaggaagaggaagaagatttgcctgatgctcaaactgcagctaaaagagcttccagaatttataacacatga

SEQ ID NO: 16783 - DNA, 1033 bp, Artificial Sequence; identical to SEQ ID NO: 7576
  Synthetic polypeptide

SEQ ID NO: 16784 - DNA, 1048 bp, Artificial Sequence; identical to SEQ ID NO: 7577
  Synthetic polypeptide

SEQ ID NO: 16785 - DNA, 892 bp, Artificial Sequence
  Synthetic polypeptide
tataacatatgtagcacactaaggctggtctccaggaggtaaggcccgccctgcaggcaacaccggtgcttgggctcctgctgagcagttctttcctgcgagtaacagaaccagggagggaggtgggctgtggcctcccctgcccctacagtcgtctcctgcagctcccaccatgctggactcatcagcagcagagcaagtgacccgactgacgctgaagctcttgggacagaagctggagcaagaacggcagaacgtggaagggggacctgagggcctccacctcgagccaggaaatgaggaccggccggacgatgccctgcagactgctctgaagagaaggagggaccttctgcagagactccgggaacaacacctcctggacgagctctctcgggcccaggcctggagcgggccaagcagaggagccctcgggtcagccctgcccccagagctgccccccacgggcatcctacccactgcctccccatccccgctggccccagacccgccaaggatcatcctgcctacggtcccccagcctcctgccaccatcattcagcagctccctcagcagccactcatagcacagattcctcctccccaggccttccctactcaacggtcaggaagtattaaggaagacatggtggagctgctgctgctgcagaacgcacaggtgcaccagttggtcctgcagaactggatgctcaaggccctgcccccagccctgcaggacccgccacatgtgcccccgagggtcccacgagctgccaggccaaggctgcctgccgtgcaccaccaccaccaccaccaccatgctgtgtggccacctggggctgccactgtcctccagcccgcccccagcctgtggacgcctggcccaccctga

SEQ ID NO: 16786 - DNA, 1627 bp, Artificial Sequence
  Synthetic polypeptide
gaggggctcagggctgagtccttggacctcttctttcttttcagcattcactcttggcggtctgattttatagctttagacactatctggtgatgactgtcacatttttgtactagcctggacttctcctggaactcaagactggcatatccaggagcgggggcgttgacgctccctggaggtctagtactcatctcaggcagaacgcgttcaaacagactcaggattttctgccccctcttcttcccaaagccttccccacctgagtaaatggaacctctgttccagccttctgggttctctcaattcacgaatctgggagtcatctcctcccctccctttcctccccactcccaactccctttactccaacaactcatccctctgcaaatcctgtcagtgcagccttcagagtagacccaggatgtgacaacttctcatcatctccactgctactgtcatatttcttgtctggagtcttctccaacagtctctgcagttgtccccttgcttccaccctttcccttccacacagcactggagtgaggtgcagtggtccagctgcaacatcttctccacccaggaccatgcggcggctgccattgccaaggctggcattccggtgtatgcctggaagggcgaaacggacgaggagtacctgtggtgcattgagcagaccctgtacttcaaggacgggcccctcaacatgattctggacgacgggggcgacctcaccaacctcatccacaccaagtacccgcagcttctgccaggcatccgaggcatctctgaggagaccacgactggggtccacaacctctacaagatgatggccaatgggatcctcaaggtgcctgccatcaatgtcaatgactccgtcaccaagagcaagtttgacaacctctatggctgccgggagtccctcatagatggcatcaagcgggccacagatgtgatgattgccggcaaggtagcggtggtagcaggctatggtgatgtgggcaagggctgtgcccaggccctgcggggtttcggagcccgcgtcatcatcaccgagattgaccccatcaacgcactgcaggctgccatggagggctatgaggtgaccaccatggatgaggcctgtcaggagggcaacatctttgtcaccaccacaggctgtattgacatcatccttggccggcactttgagcagatgaaggatgatgccattgtgtgtaacattggacactttgacgtggagatcgatgtcaagtggctcaacgagaacgccgtggagaaggtgaacatcaagccgcaggtggaccggtatcggttgaagaatgggcgccgcatcatcctgctggccgagggtcggctggtcaacctgggttgtgccatgggccaccccagcttcgtgatgagtaactccttcaccaaccaggtgatggcgcagatcgagctgtggacccatccagacaagtaccccgttggggttcatttcctgcccaagaagctggatgaggcagtggctgaagcccacctgggcaagctgaatgtgaagttgaccaagctaactgagaagcaagcccagtacctgggcatgtcctgtgatggccccttcaagccggatcactaccgctactga

SEQ ID NO: 16787 - DNA, 1272 bp, Artificial Sequence; identical to SEQ ID NO: 10519
  Synthetic polypeptide

SEQ ID NO: 16788 - DNA, 694 bp, Artificial Sequence
  Synthetic polypeptide
atagacaagtggatggaaggagagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16789 - DNA, 1729 bp, Artificial Sequence
  Synthetic polypeptide
ttatctccctcaaatcttttttcagaaagctactggagggtgcattgtactaaggaagagagagactgatgactgaggaaggattggaacgcagggagcaggatatccgtcactgggggagaagcagctgaagatgatgcctgtgcccgggcagatggtgctcagtcctcagagcaggaagtggtgccgagaaagtctccccaaagacgagattgccaggcagcccgatgccgggtgagcatggacatctccagaggagatttgaacagtttaaagagccagggtggaatgagcgataaacagacagctaagcaagtgaaaaaccccttctcctgttagcttgaggggaagcacaaagtaggaaggagttggaagtcaccatggtttcctttgtggcctcagtgtgagtggttgagcacccagctgtgctcagctagacgcggggctcagccagacgcggggcagctagagctgtggtgatggtggtacctgcggggcggcagaggggtggtgggagcacagagccatggcctcctcttccatcctgagaagtcacaggactccagaagacctttccagattcgtggttgagctgcagcagagggagcttgccttgaaggacaagaacagcgccgtcaccagcagcgcccgggggctggagaaggccaggcagcagctgcaggaggagctccggcaggtcagcggccagctgttggaggagaggaagaagcgcgagacccacgaggcgctggcccggaggctccagaaacgggtcctgctgctcaccaaggagcgggacggtatgcgggccatcctggggtcctacgacagcgagctgaccccggccgagtactcaccccagctgacgcggcgcatgcgggaggctgaggatatggtgcagaaggtgcacagccacagcgccgagatggaggctcagctgtcgcaggccctggaggagctgggaggccagaaacaaagagcagacatgctggagatggagctgaagatgctgaagtctcagtccagctctgccgaacagagcttcctgttctccagggaggaggcggacacgctcaggttgaaggtcgaggagctggaaggcgagcggagtcggctggaggaggaaaagaggatgctggaggcacagctggagcggcgagctctgcagggtgactatgaccagagcaggaccaaagtgctgcacatgagcctgaaccccaccagtgtggccaggcagcgcctgcgcgaggaccacagccagctgcaggcggagtgcgagcgactgcgcgggctcctgcgcgccatggagagaggaggcaccgtcccagccgaccttgaggctgccgccgcgagtctgccatcgtccaaggaggtggcagagctgaagaagcaggtggagagtgccgagctgaagaaccagcggctcaaggaggttttccagaccaagatccaggagttccgcaaggcctgctacacgctcaccggctaccagatcgacatcaccacggagaaccagtaccggctgacctcgctgtacgccgagcacccaggcgactgcctcatcttcaaggccaccagcccctcgggttccaagatgcagctactggagacagagttctcacacaccgtgggcgagctcatcgaggtgcacctgcggcgccaggacagcatccctgccttcctcagctcgctcaccctcgagctcttcagccgccagaccgtggcgtag

SEQ ID NO: 16790 - DNA, 857 bp, Artificial Sequence; identical to SEQ ID NO: 8024
  Synthetic polypeptide

SEQ ID NO: 16791 - DNA, 729 bp, Artificial Sequence
  Synthetic polypeptide
gttgatcagtggtaaatatgaaaagaactgggttttctagctgactacagatttaatatcatctagcaacctatgtggctgttaacatagctgttctgtctttggatggtttaaaatcatctgactcccacaccacagagaagaatcattcttgccttcctctccagtcaacagctcacagccatggactgcaggacactccgccttgagaacactttaaaatggccattgcccatctgtaatggcttccgtgccaccaaggtgatgaggaatcccaaaactgtgacagagaagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctag

SEQ ID NO: 16792 - DNA, 67 bp, Artificial Sequence; identical to SEQ ID NO: 16124
  Synthetic polypeptide

SEQ ID NO: 16793 - DNA, 871 bp, Artificial Sequence; identical to SEQ ID NO: 437
  Synthetic polypeptide

SEQ ID NO: 16794 - DNA, 421 bp, Artificial Sequence; identical to SEQ ID NO: 441
  Synthetic polypeptide

SEQ ID NO: 16795 - DNA, 638 bp, Artificial Sequence; identical to SEQ ID NO: 442
  Synthetic polypeptide

SEQ ID NO: 16796 - DNA, 337 bp, Artificial Sequence; identical to SEQ ID NO: 443
  Synthetic polypeptide

SEQ ID NO: 16797 - DNA, 3021 bp, Artificial Sequence; identical to SEQ ID NO: 449
  Synthetic polypeptide

SEQ ID NO: 16798 - DNA, 3075 bp, Artificial Sequence; identical to SEQ ID NO: 450
  Synthetic polypeptide

SEQ ID NO: 16799 - DNA, 1143 bp, Artificial Sequence; identical to SEQ ID NO: 451
  Synthetic polypeptide

SEQ ID NO: 16800 - DNA, 179 bp, Artificial Sequence
  Synthetic polypeptide
gctgagtgtggtggtgcatctgtaattccagctacttgagaggccgaggtgggaggatcgcttgagcccgggagttccagtctgcagtgagctatgtcttgccccagaagctgcgggcacatccacgcctgaaatgcggcgctcagtcctggtcaggaacccaggccacaaaggcctga

SEQ ID NO: 16801 - DNA, 913 bp, Artificial Sequence
  Synthetic polypeptide
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctccacaagcagcaggaccccaccgtgctgcccctgcttgaatgcatcgtgctggaccgcgtccccgccttccgtgacgagcacctgcagggcctgacgcgcttccgggccttgcgctcgctggtgctgggtggtacctaccgtgtgaccgagacagggctggatgctggcctgcaggagctcagctatctgcagaggcttgaggtgctgggctgcaccctgtctgccgacagcaccctgctggccatcagccgccacctccgagatgtgcgcaagatccggctgaccgtgaggggcctctctgcccctggcctggctgtgctggagggaatgccggccctggagagtctgtgcctgcagggtcccctcgtcaccccagaaatgccctcccccactgaaatcctctcctcctgcctcactatgcccaagctcagagtccttgagctgcaggggctggggtgggagggtcaggaggcggagaagatcctgtgtaaggggctgccccactgtatggtcatcgtcagggcttgccccaaagagtctatggactggtggatgtaa

SEQ ID NO: 16802 - DNA, 355 bp, Artificial Sequence
  Synthetic polypeptide
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttgagagccctgggccagaagtgccccaacctgaagcgcctctgcctgcacgtggccgacctgagcatggtgcccatcaccagcctgcccagcaccttgaggaccctggagctgcacagctgcgagatctccatggcctggctc

SEQ ID NO: 16803 - DNA, 215 bp, Artificial Sequence
  Synthetic polypeptide
gcttctttctcattttctcttgctgccgccatgtaagaagtgcctttcacctcctgccatgattttgaggcctccccagccatgtggaactatgcgacctaaagtcatgtggcacctccttcgaaggtacatggcatcccggctccattccctgcggatgggtggctacctgttctctggctcccaggccccccagttgtcccctgctctgttga

SEQ ID NO: 16804 - DNA, 102 bp, Artificial Sequence
  Synthetic polypeptide
gcttctttctcattttctcttgctgccgccatgtaagaagtgcctttcacctcctgccatgattttgaggcctccccagccatgtggaactatgcgacctaa

SEQ ID NO: 16805 - DNA, 1061 bp, Artificial Sequence
  Synthetic polypeptide
cagcaggtcctcaaataatgccattttgttcaacattgttttgttatcatgttgatgaggaaaaaaagaaatcacttcctggctgggaccactgaccacgtggagtttgcacattctgcccatgtctgcacgggttttccctgggtactccagtttcctctcacctcccagagagccgcgcattagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttga

SEQ ID NO: 16806 - DNA, 896 bp, Artificial Sequence
  Synthetic polypeptide
cagcaggtcctcaaataatgccattttgttcaacattgttttgttatcatgttgatgaggaaaaaaagaaatcacttcctggctgggaccactgaccacgtggagtttgcacattctgcccatgtctgcacgggttttccctgggtactccagtttcctctcacctcccagagagccgcgcattagaatatttaaaagatgcttcaaagaagatgaaaaatgggctaatgtttgtaaaactggttaacccctgttcaggagaaggagccatttacttgttcaatatgtgtctacagcagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagatggcagcacaaagacagaaaaggggcaagtga

SEQ ID NO: 16807 - DNA, 118 bp, Artificial Sequence; identical to SEQ ID NO: 7912
  Synthetic polypeptide

SEQ ID NO: 16808 - DNA, 435 bp, Artificial Sequence; identical to SEQ ID NO: 7913
  Synthetic polypeptide

SEQ ID NO: 16809 - DNA, 519 bp, Artificial Sequence; identical to SEQ ID NO: 7914
  Synthetic polypeptide

SEQ ID NO: 16810 - DNA, 480 bp, Artificial Sequence; identical to SEQ ID NO: 7915
  Synthetic polypeptide

SEQ ID NO: 16811 - DNA, 597 bp, Artificial Sequence; identical to SEQ ID NO: 7916
  Synthetic polypeptide

SEQ ID NO: 16812 - DNA, 440 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 16813 - DNA, 778 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 16814 - DNA, 408 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctga

SEQ ID NO: 16815 - DNA, 597 bp, Artificial Sequence
  Synthetic polypeptide
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactga

SEQ ID NO: 16816 - DNA, 750 bp, Artificial Sequence
  Synthetic polypeptide
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacggaagaatacaaagaagcctcagaggggctcagcctgagaaaacctggctctcaggaagaactttgcaagagcagccgtggaggacagagtgctcttgggcccccatggcccaaatgcagagttacccccactgccctgtggagaaccgggaagatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactga

SEQ ID NO: 16817 - DNA, 543 bp, Artificial Sequence
  Synthetic polypeptide
caggggaagtaatgaaacatatagaagaaaatttctctaaagaaggaagacttgaggctgcatattgaaaggtaaaactgataagagaagacactaagcatgtcctggtaacgtttctgaactcttaggatgaagagaaaaatcttcaagctttcagaagccaaaggaacaaattattaaggaaaagagtcacactggcaccagatttcctatttacaacaccaagaagctagaagatggtggaatttcatctacagaccacggggataaaaggaatgcagctcaagcatcctgtacccaggcaagctatccattcagctgtcagaatgaaagaaaggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaaggtag

SEQ ID NO: 16818 - DNA, 213 bp, Artificial Sequence
  Synthetic polypeptide
aaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggaagaagagtttacaacagatgaagcagatgaaactaggagcaatgaaacccagaatcctcataaaccatc

SEQ ID NO: 16819 - DNA, 400 bp, Artificial Sequence
  Synthetic polypeptide
aaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaa

SEQ ID NO: 16820 - DNA, 629 bp, Artificial Sequence; identical to SEQ ID NO: 7943
  Synthetic polypeptide

SEQ ID NO: 16821 - DNA, 472 bp, Artificial Sequence; identical to SEQ ID NO: 7944
  Synthetic polypeptide

SEQ ID NO: 16822 - DNA, 1227 bp, Artificial Sequence; identical to SEQ ID NO: 7622
  Synthetic polypeptide

SEQ ID NO: 16823 - DNA, 362 bp, Artificial Sequence
  Synthetic polypeptide
gtcagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattga

SEQ ID NO: 16824 - DNA, 543 bp, Artificial Sequence; identical to SEQ ID NO: 6496
  Synthetic polypeptide

SEQ ID NO: 16825 - DNA, 378 bp, Artificial Sequence; identical to SEQ ID NO: 6497
  Synthetic polypeptide

SEQ ID NO: 16826 - DNA, 267 bp, Artificial Sequence; identical to SEQ ID NO: 6498
  Synthetic polypeptide

SEQ ID NO: 16827 - DNA, 416 bp, Artificial Sequence; identical to SEQ ID NO: 6499
  Synthetic polypeptide

SEQ ID NO: 16828 - DNA, 162 bp, Artificial Sequence; identical to SEQ ID NO: 6500
  Synthetic polypeptide

SEQ ID NO: 16829 - DNA, 405 bp, Artificial Sequence; identical to SEQ ID NO: 7860
  Synthetic polypeptide

SEQ ID NO: 16830 - DNA, 274 bp, Artificial Sequence; identical to SEQ ID NO: 7861
  Synthetic polypeptide

SEQ ID NO: 16831 - DNA, 196 bp, Artificial Sequence; identical to SEQ ID NO: 7862
  Synthetic polypeptide

SEQ ID NO: 16832 - DNA, 268 bp, Artificial Sequence; identical to SEQ ID NO: 7863
  Synthetic polypeptide

SEQ ID NO: 16833 - DNA, 186 bp, Artificial Sequence; identical to SEQ ID NO: 7864
  Synthetic polypeptide

SEQ ID NO: 16834 - DNA, 204 bp, Artificial Sequence; identical to SEQ ID NO: 7897
  Synthetic polypeptide

SEQ ID NO: 16835 - DNA, 287 bp, Artificial Sequence; identical to SEQ ID NO: 7993
  Synthetic polypeptide

SEQ ID NO: 16836 - DNA, 914 bp, Artificial Sequence; identical to SEQ ID NO: 7994
  Synthetic polypeptide

SEQ ID NO: 16837 - DNA, 674 bp, Artificial Sequence; identical to SEQ ID NO: 7995
  Synthetic polypeptide

SEQ ID NO: 16838 - DNA, 308 bp, Artificial Sequence; identical to SEQ ID NO: 7996
  Synthetic polypeptide

SEQ ID NO: 16839 - DNA, 175 bp, Artificial Sequence; identical to SEQ ID NO: 7997
  Synthetic polypeptide

SEQ ID NO: 16840 - DNA, 777 bp, Artificial Sequence; identical to SEQ ID NO: 16570
  Synthetic polypeptide

SEQ ID NO: 16841 - DNA, 505 bp, Artificial Sequence; identical to SEQ ID NO: 16571
  Synthetic polypeptide

SEQ ID NO: 16842 - DNA, 187 bp, Artificial Sequence; identical to SEQ ID NO: 7942
  Synthetic polypeptide

SEQ ID NO: 16843 - DNA, 294 bp, Artificial Sequence; identical to SEQ ID NO: 7554
  Synthetic polypeptide

SEQ ID NO: 16844 - DNA, 208 bp, Artificial Sequence; identical to SEQ ID NO: 7555
  Synthetic polypeptide

SEQ ID NO: 16845 - DNA, 147 bp, Artificial Sequence; identical to SEQ ID NO: 6327
  Synthetic polypeptide

SEQ ID NO: 16846 - DNA, 589 bp, Artificial Sequence; identical to SEQ ID NO: 16101
  Synthetic polypeptide

SEQ ID NO: 16847 - DNA, 848 bp, Artificial Sequence; identical to SEQ ID NO: 7921
  Synthetic polypeptide

SEQ ID NO: 16848 - DNA, 230 bp, Artificial Sequence; identical to SEQ ID NO: 7922
  Synthetic polypeptide

SEQ ID NO: 16849 - DNA, 476 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaa

SEQ ID NO: 16850 - DNA, 814 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctgatccaagaacggcttggcagccagtccggctaagtggagctcagagcggatgggcacacacacccgccctgtgtgtgtcccctcacgcaagtgccagggctgggccccttccaaatgtccctccaacacagatccgcaagagtaaaggaaataagagcagtcacaacagagtgaaaaatcttaagtaccaatgggaagcagggaattcctggggtaaagtatcacttttctggggctgggctaggcataggtctctttgctttctggtggtggcctgtttgaaagtaaaaacctgcttggtgtgtaggttccgtatctccctggagaagcaccagcaattctctttcttttactgttatagaatagcctga

SEQ ID NO: 16851 - DNA, 444 bp, Artificial Sequence
  Synthetic polypeptide
tgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacgcaacagggagctgccaccaccgtgtactgtgctgctgtcccagaactggagggtctgggagggatgtacttcaacaactgctgccgctgcatgccctcaccagaagctcagagcgaagagacggcccggaccctgtgggcgctcagcgagaggctga

SEQ ID NO: 16852 - DNA, 557 bp, Artificial Sequence; identical to SEQ ID NO: 6591
  Synthetic polypeptide

SEQ ID NO: 16853 - DNA, 191 bp, Artificial Sequence
  Synthetic polypeptide
atagtattgcacagtgacgaagagtgctgactttggggtcagactgggtttgaatctccctgtttactaactgggaatacatgcaccacctgctcgccctggagcatcgcgctgaggagcagttcctggagcactggctgaaccctcactgcaaaccccactgtgacaggaacaggattcatcctgtgtaa

SEQ ID NO: 16854 - DNA, 1516 bp, Artificial Sequence; identical to SEQ ID NO: 534
  Synthetic polypeptide

SEQ ID NO: 16855 - DNA, 591 bp, Artificial Sequence; identical to SEQ ID NO: 539
  Synthetic polypeptide

SEQ ID NO: 16856 - DNA, 482 bp, Artificial Sequence; identical to SEQ ID NO: 540
  Synthetic polypeptide

SEQ ID NO: 16857 - DNA, 444 bp, Artificial Sequence; identical to SEQ ID NO: 541
  Synthetic polypeptide

SEQ ID NO: 16858 - DNA, 334 bp, Artificial Sequence; identical to SEQ ID NO: 533
  Synthetic polypeptide

SEQ ID NO: 16859 - DNA, 38 bp, Artificial Sequence; identical to SEQ ID NO: 543
  Synthetic polypeptide

SEQ ID NO: 16860 - DNA, 245 bp, Artificial Sequence; identical to SEQ ID NO: 542
  Synthetic polypeptide

SEQ ID NO: 16861 - DNA, 513 bp, Artificial Sequence
  Synthetic polypeptide
ggccgggcacggtggctcacgtctgtaatcccagcactttgggaggctgagacgggaggatcccctgaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctga

SEQ ID NO: 16862 - DNA, 426 bp, Artificial Sequence
  Synthetic polypeptide
ggccgggcacggtggctcacgtctgtaatcccagcactttgggaggctgagacgggaggatcccctgaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagag

SEQ ID NO: 16863 - DNA, 2825 bp, Artificial Sequence; identical to SEQ ID NO: 6727
  Synthetic polypeptide

SEQ ID NO: 16864 - DNA, 987 bp, Artificial Sequence
  Synthetic polypeptide
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactga

SEQ ID NO: 16865 - DNA, 826 bp, Artificial Sequence
  Synthetic polypeptide
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccc

SEQ ID NO: 16866 - DNA, 509 bp, Artificial Sequence
  Synthetic polypeptide
ctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatgttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagg

SEQ ID NO: 16867 - DNA, 582 bp, Artificial Sequence
  Synthetic polypeptide
tggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactga

SEQ ID NO: 16868 - DNA, 196 bp, Artificial Sequence
  Synthetic polypeptide
tggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctga

SEQ ID NO: 16869 - DNA, 1280 bp, Artificial Sequence
  Synthetic polypeptide
cctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggtgctctcttttctgctgtggcctgtgtgaatagcctggccatgctgacggcctccggcttcaactcactctacccagccactctgaactttatgaaggggttccccttcctcctgggagctggcctcctgctcatcccggctgttctgattgggatgctggaaaaggctgatcctcacctcgagttccagcagtttccccagagcccctga

SEQ ID NO: 16870 - DNA, 1367 bp, Artificial Sequence
  Synthetic polypeptide
cctcgtttcctcagcggtagatagcgatggttaatattggctagcctgtagagttatcgggagaccaacgcacaaaaagggtttaataccgtgcccagcacataggcccgctcaccacgcagtatctgtggcaccgcttcagcgccgacctcggctacaatggcacccgccaaagggggggctgcagcaaccgcagcgcggaccccaccatgcaggaagtggagacccttacctcccactggaccctctacatgaacgtgggcggcttcctggtggggctcttctcgtccaccctgctgggagcttggagcgacagtgtgggccgccgcccgctgctagtgctggcctcgctgggcctgctgctccaggccctagtgtccgtttttgtggtgcagctgcagctccacgtcggctacttcgtgctgggtcgcatcctttgtgccctcctcggcgacttcggtggccttctggctgctagctttgcgtccgtggcagatgtcagctccagtcgcagccgcaccttccggatggccctgctggaagccagcatcggggtggctgggatgctggcaagcctcctcgggggccactggctccgggcccagggttatgccaaccccttctggctggccttggccttgctgatagccatgactctctatgcagctttctgctttggtgagaccttaaaggagccaaagtccacccggctcttcacgttccgtcaccaccgatccattgtccagctctatgtggctcccgccccagagaagtccaggaaacatttagccctctactcactggccatcttcgtggtgatcactgtgcactttggggcccaggacatcttaaccctttatgaactaagcacacccctctgctgggactccaaactaatcggctatggttctgcagctcagcatctcccctacctcaccagcctgctggccctgaagctcctgcagtactgcctggccgatgcctgggtagctgagatcggcctggccttcaacatcctggggatggtggtctttgcctttgccactatcacgcctctcatgttcacaggatatgggttgcttttcctgtcattagtcatcacacctgtcatccgggctaaactctccaagctggtgagagagacagagcagggtgctctcttttctgctgtggcctgtgtgaatagcctggccatgctgacggcctccggcattttcaactcactctacccagccactctgaactttatgaaggggttccccttcctcctgggagctggcctcctgctcatcccggctgttctgattgggatgctggaaaaggctgatcctcacctcgagttccagcagtttccccagagcccctga

SEQ ID NO: 16871 - DNA, 437 bp, Artificial Sequence
  Synthetic polypeptide
ggccaggcgcggtggctcttgcctgtaatctcagcactttggatgccaaggcgggtggatcacttgaggtcaggagttcaagaccagccagcacaacatgctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtga

SEQ ID NO: 16872 - DNA, 180 bp, Artificial Sequence
  Synthetic polypeptide
ggccaggcgcggtggctcttgcctgtaatctcagcactttggatgccaaggcgggtggatcacttgaggtcaggagttcaagaccagccagcacaacatgctgtgagaccaaagacctggttgtgcaacaggcaggcacaaacaagactgatgttgtctgtggtccccaggatcggctga

SEQ ID NO: 16873 - DNA, 2483 bp, Artificial Sequence
  Synthetic polypeptide
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactga

SEQ ID NO: 16874 - DNA, 704 bp, Artificial Sequence
  Synthetic polypeptide
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccagctcccaaagtggatgaagatgaagaagcactaaagcagttggctgagtgggtatcctga

SEQ ID NO: 16875 - DNA, 407 bp, Artificial Sequence
  Synthetic polypeptide
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatgtggggacattga

SEQ ID NO: 16876 - DNA, 645 bp, Artificial Sequence
  Synthetic polypeptide
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccag

SEQ ID NO: 16877 - DNA, 227 bp, Artificial Sequence
  Synthetic polypeptide
gcccggcgcgggggctcacgcctgtactcgcaacactttgggaggccgacgtgggtggatcatgagggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagtttcagcgtga

SEQ ID NO: 16878 - DNA, 1273 bp, Artificial Sequence; identical to SEQ ID NO: 6700
  Synthetic polypeptide

SEQ ID NO: 16879 - DNA, 1357 bp, Artificial Sequence; identical to SEQ ID NO: 6701
  Synthetic polypeptide

SEQ ID NO: 16880 - DNA, 1546 bp, Artificial Sequence; identical to SEQ ID NO: 6702
  Synthetic polypeptide

SEQ ID NO: 16881 - DNA, 1621 bp, Artificial Sequence; identical to SEQ ID NO: 6703
  Synthetic polypeptide

SEQ ID NO: 16882 - DNA, 1282 bp, Artificial Sequence; identical to SEQ ID NO: 6704
  Synthetic polypeptide

SEQ ID NO: 16883 - DNA, 1639 bp, Artificial Sequence; identical to SEQ ID NO: 6705
  Synthetic polypeptide

SEQ ID NO: 16884 - DNA, 614 bp, Artificial Sequence; identical to SEQ ID NO: 10761
  Synthetic polypeptide

SEQ ID NO: 16885 - DNA, 50 bp, Artificial Sequence; identical to SEQ ID NO: 10762
  Synthetic polypeptide

SEQ ID NO: 16886 - DNA, 209 bp, Artificial Sequence; identical to SEQ ID NO: 10763
  Synthetic polypeptide

SEQ ID NO: 16887 - DNA, 617 bp, Artificial Sequence; identical to SEQ ID NO: 10764
  Synthetic polypeptide

SEQ ID NO: 16888 - DNA, 771 bp, Artificial Sequence
  Synthetic polypeptide
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagatgcactcaactgtcctctcttctgctcttcctcctacaaactgggcaactggaatcagaacagagactttggatgagcatccagtgtaa

SEQ ID NO: 16889 - DNA, 546 bp, Artificial Sequence
  Synthetic polypeptide
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatag

SEQ ID NO: 16890 - DNA, 648 bp, Artificial Sequence
  Synthetic polypeptide
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagagacaacattttgctctgtcacccaagctgaactgaactgggctccagaaatcctcccacctcagcctcctgagcagctaggactacagatgtgccaccatacccagctaattttttaa

SEQ ID NO: 16891 - DNA, 594 bp, Artificial Sequence
  Synthetic polypeptide
tgatctggtttggctctgtgtgcccacctaaatctcatgttgaactataattcccagtgttgtgggagggacctggtgggaagtgattggatcatgggggtgaatttcccttttgctgttcttgtgatagtgagtgagttctcatgagatctggttatttaaaagtgtatagccctttccgcctttgctctctctcctgttctgccatgtgaagatgtgcaggcatccccttcgcctcctgccacagttgttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagaattttggcacatttgcatatctggtttctcaatccagaacagactaaaagaaaatgagtcctga

SEQ ID NO: 16892 - DNA, 675 bp, Artificial Sequence
  Synthetic polypeptide
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctga

SEQ ID NO: 16893 - DNA, 375 bp, Artificial Sequence
  Synthetic polypeptide
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgaggctcaaaaatga

SEQ ID NO: 16894 - DNA, 603 bp, Artificial Sequence
  Synthetic polypeptide
cctccgtttcctcatctgcgcatgggaataagcctaccatgagtgttgttggaaacaccagactggtcccccaaggtggtggagctgtgtaagaagtaccagcagcagaccgtggtagccattgacctggctggagatgagaccatcccaggaagcagcctcttgcctggacatgtccaggcctaccaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctga

SEQ ID NO: 16895 - DNA, 241 bp, Artificial Sequence
  Synthetic polypeptide
ggggaggagccaagatggccgaataggaacagctccggtctacagctcccagcgtgagcgacgcagaagacgggtgatttctgcatttccatctgaggtaccgggttcatctcactagggagtgccagacagtgggcgcaggccaaggcggtgggaccgaagttacctctggagtatgaaaataagcaacaccattatgaaaagtcaaaagaactttggagtcaaacagtcctgcatttga

SEQ ID NO: 16896 - DNA, 509 bp, Artificial Sequence
  Synthetic polypeptide
atggaggatagatggctgatagaagaaaggatggataaacaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggctcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctgccctcagggctccttcctccagtcttggagcattttttgcaggtgacctgcctcctcctctgcaggctggagctgcctga

SEQ ID NO: 16897 - DNA, 1520 bp, Artificial Sequence
  Synthetic polypeptide
gccgggcgcggtggctcacacctgtaatcccagcactttgggaggacaagctcgtcgtcaaggtgcacatgaatgataacagcacaaagtcactgatggtggatgagcggcagctggcccgagatgttctggacaaccttttcgagaaaactcattgtgactgcaatgtagactggtgtctttatgaaatctacccggaactacaaattgagaggttttttgaagaccatgaaaatgttgttgaagtcttatcagactggacaagagacacagaaaataaaatactatttttggagaaagaggagaaatatgctgtatttaaaaacccccagaatttctacttggataacagaggaaaaaaagaaagcaaggaaactaatgagaaaatgaatgctaagaacaaggaatccttacttgaggaaagtttctgtggaacatctatcattgtaccagaactggaaggagctctttatttgaaagaagatggaaagaaatcctggaaaaggcgctattttcttttacgggcttctggaatttattatgtacccaaaggaaagactaagacatctcgagatctggcgtgttttatacagtttgaaaatgtcaacatttactatgggactcagcataaaatgaaatataaagcgcccactgactattgctttgttttaaagcacccccaaattcagaaggagtcccagtatatcaagtatctctgctgtgatgacacaagaacccttaaccagtgggtcatgggaatacggatagccaagtatgggaagactctctatgataactaccagcgggctgtggcaaaggctggacttgcctctcggtggacaaacttggggacagtcaatgcagctgcaccagctcagccatctacaggacctaaaacaggcaccacccagcccaatggacagattccccaggctacacattctgtcagtgctgttctccaagaggcccagagacatgctgaaacatcgaaggataagaagccagccctcgggaaccaccacgacccggcagtgccccgggccccgcacgcccccaagtccagcctgcccccgccccctccggtgcggaggtcctccgacaccagcggcagtcccgccacgcccctcaaggccaagggcacaggcggcgggggcttgcccgccccacccgacgacttcctgccgccgccgccaccgccgccgcccctcgatgaccctgagctcccgccgccgcccccggacttcatggagccgcccccagacttcgtgcccccgcccccgccgtcgtacgcagggatcgcgggctcagagctgcccccgccgccgccgccgccgcccgcgcccgcgcccgcccccgtccccgactccgccaggccgccccccgcggtggccaagaggcctcctgtgccccccaagaggcaagagaacccagggcaccccggcggagcaggaggcggggagcaagatttcatgtcagacctcatgaaagctttgcaaaagaagagaggcaacgtgtcctag

SEQ ID NO: 16898 - DNA, 1206 bp, Artificial Sequence; identical to SEQ ID NO: 7670
  Synthetic polypeptide

SEQ ID NO: 16899 - DNA, 1134 bp, Artificial Sequence; identical to SEQ ID NO: 7671
  Synthetic polypeptide

SEQ ID NO: 16900 - DNA, 1002 bp, Artificial Sequence; identical to SEQ ID NO: 7672
  Synthetic polypeptide

SEQ ID NO: 16901 - DNA, 1036 bp, Artificial Sequence; identical to SEQ ID NO: 754
  Synthetic polypeptide

SEQ ID NO: 16902 - DNA, 338 bp, Artificial Sequence; identical to SEQ ID NO: 6370
  Synthetic polypeptide

SEQ ID NO: 16903 - DNA, 242 bp, Artificial Sequence; identical to SEQ ID NO: 6371
  Synthetic polypeptide

SEQ ID NO: 16904 - DNA, 451 bp, Artificial Sequence
  Synthetic polypeptide
ggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttag

SEQ ID NO: 16905 - DNA, 665 bp, Artificial Sequence
  Synthetic polypeptide
ggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctag

SEQ ID NO: 16906 - DNA, 135 bp, Artificial Sequence
  Synthetic polypeptide
agcgtcacgttatggaaagagcagagcccaggaatgaggccacccagtctcccaggtggaaaacgaagctcattcccaacgtgcaaagccaaggcagcgaccccaggacctcttctggagatggaagcttgttga

SEQ ID NO: 16907 - DNA, 463 bp, Artificial Sequence; identical to SEQ ID NO: 803
  Synthetic polypeptide

SEQ ID NO: 16908 - DNA, 289 bp, Artificial Sequence
  Synthetic polypeptide
aaaatcaaggattagccaggcctggtaatgtattcctgtaatcctagctcagtgctgcggtgggaagattgctggagcccaggagttcgaggctgcgtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtacaggtccaagaatgacagctgcctacatctga

SEQ ID NO: 16909 - DNA, 334 bp, Artificial Sequence
  Synthetic polypeptide
aaaatcaaggattagccaggcctggtaatgtattcctgtaatcctagctcagtgctgcggtgggaagattgctggagcccaggagttcgaggctgcgtggcatgccctctcccgtgaagagcaggctaaatattatgaattagcacggaaagaaagacagctacatatgcagctttatccaggctggtctgcaagagacaattatggtaagaaaaagaagaggaagagagagaaactacaggaatctgcatcaggtggaaaacgaagctcattcccaacgtgcaaagccaaggcagcgaccccaggacctcttctggagatggaagcttgttga

SEQ ID NO: 16910 - DNA, 6087 bp, Artificial Sequence
  Synthetic polypeptide
gaggaggaggaggaggaggaggaggaggaggaggaggaggaggacgacgacgagggagtactcgggcgcgggccgggccacgaccggggccgcgaccgccacagcccccccggctgccacctcttcccgccgccgccgccgccgccgccaccgctgcccccgccgccgccgcccccgccgccagataaggatgacattcggctgctgccgtcagcattgggtgtgaagaagagaaaacgaggacccaagaagcagaaggagaacaagccaggaaaaccccgaaaacgcaagaagcgtgacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaagcaagtggaacagaagtcatcagcaactctgcttctgacctggggcctggaggatgtggagcatgtgttctctgaggaggattaccacacgctcaccaactacaaagccttcagccagttcatgaggcccctaattgctaagaagaatcctaagatcccaatgtctaagatgatgaccatccttggggccaaatggagagagttcagtgccaacaaccccttcaaggggtcagcagctgctgtggcggcggcagcggcagcagcagcagcagctgtagctgagcaggtgtcagctgctgtctcgtcggccacccccatagcaccctccggaccccccgcccttccaccaccccctgctgctgatatccagcccccacccatccgaagagccaaaaccaaagagggcaaaggtccaggccataagaggcggagtaagagcccccgagtgcctgatggacgcaagaagcttcggggaaagaaaatggcaccactcaaaataaaactagggcttctgggtggcaagaggaagaaaggaggctcgtatgtttttcagagcgacgaaggtcctgaaccagaggctgaggaatcagacctggacagtggcagtgtccacagtgcctcaggccggcctgatggccctgtccgcaccaagaaactaaagagaggccggccaggaaggaagaagaagaaggtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacatgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacagtgtggataaaaaggggaattaccactatctagtaaaatggagggacttaccatatgaccagtccacgtgggaggaagatgaaatgaatatccctgaatacgaagaacataagcaaagctactggagacaccgagaactaattatgggggaagaccctgcccagccccgcaagtataagaagaagaagaaggagctacagggtgatgggcctcccagttctcccactaatgatcctaccgtgaaatatgagactcagccacggtttatcacagccactggaggcaccctgcacatgtatcagttggaagggctgaactggctacgcttctcctgggcccagggcactgacaccattctagctgatgagatggggctaggcaagaccatacaaaccatcgtcttcctctactcactctacaaggagggccacacaaaaggtcccttcctggtgagtgccccactctctaccatcattaactgggagcgggagttccagatgtgggcacccaaattctatgtggtgacatacacgggtgacaaggacagccgggccatcattcgtgagaatgaattctcctttgaggacaatgccatcaaagggggcaagaaagcttttaagatgaagagggaggcacaggtgaagttccatgttctcctgacatcgtatgagctgatcaccattgatcaggcagcacttggttccatccgctgggcctgtcttgtggtagatgaggcccatcgactcaagaacaaccagtccaagtttttcagggttctcaatggttacaagatagatcataagttgctgctgacaggaaccccattgcagaataatctggaggagctcttccatctcctgaacttcctcaccccagagagatttaacaacttggagggcttcctggaggagtttgctgacatatccaaagaggaccagatcaagaaactgcatgatttgctggggccacacatgctgcggagactcaaggcagatgtctttaagaacatgccagccaagacagagctcatcgttcgggtggagctaagccccatgcagaagaaatactacaaatacatcctgactcgaaattttgaggccttgaattcacgaggtggtgggaaccaggtgtcgctgcttaatatcatgatggatcttaagaagtgctgcaaccatccatacctttttcccgtggctgctatggagtcccccaaactccccagtggggcttatgagggtggggcacttattaagtcgtctgggaagctcatgctgctccagaagatgctgcgaaagctgaaggagcaaggacaccgagtgctcatcttctcgcagatgaccaaaatgttagacttgcttgaggacttcttagactatgaaggctacaagtatgagcgcatcgatggtggtatcacgggtgccctgaggcaggaggccatcgatcggtttaatgctcctggggcccaacaattctgcttcctcctgtccacccgagctgggggcctgggcatcaatctggccactgctgacactgtcatcatctttgattctgactggaacccccataatgacatccaggcctttagccgggctcatcggattggccaggccaacaaagtgatgatttaccggtttgtgactcgcgcgtcagtggaagagcgaatcacacaagtggccaagagaaagatgatgctgacacacctggttgtgcggcctgggctgggctccaaggcaggctccatgtccaagcaggagcttgacgacattctcaaatttggcactgaagagctattcaaggatgaaaacgagggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaagattgaggaaattgagcgagagatcatcaagcaggaggagaatgtggaccctgactactgggagaagctgctgaggcatcactatgagcaacagcaggaagacctagcccggaatctaggcaagggcaagcgggttcgcaagcaagttaactacaatgatgctgctcaggaagaccaagacaaccagtcagagtactcggtgggttcagaggaggaggatgaagacttcgatgaacgtcctgaagggcgtagacagtcaaagaggcagctccggaatgagaaagataagccactgcctccactgctggcccgagtcgggggcaacattgaggtgctgggcttcaacacccgtcagcggaaggctttcctcaatgctgtgatgcgctgggggatgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtgcaggagtttgagcacatcaatgggcgttggtcaatgccggaactgatgcctgaccccagcgccgattctaagcgctcctccagagcctcctctcctaccaaaacgtctcccaccactcctgaggcttctgctaccaacagtccctgcacctctaaacctgctactccagctccaagtgagaaaggagaaggcataaggacacctcttgagaaggaggaagctgaaaaccaggaggaaaagccagagaagaacagcagaattggggagaagatggagacagaggctgatgcccccagcccagccccatcacttggggagcggctggagccaaggaagattcctctagaggatgaggtgccaggggtgcctggagagatggagcctgaacctgggtaccgtggggacagagagaagtcagccacagagtcgacgccaggagaaaggggggaggagaagccgttggatggacaggaacacagggagaggccggagggggaaacaggggatttgggcaagagagaagatgtaaaaggtgaccgggagcttcgaccagggcctcgagatgagccacggtccaatgggcgacgagaggaaaagacagagaagccccggttcatgttcaatatcgccgatggtggcttcacagagcttcacacactgtggcagaatgaggaacgggcagctatttcctcggggaaactcaatgagatctggcacagaagacatgactattggcttctggctgggattgtcctccatggctatgcacggtggcaggacatccagaatgatgctcaatttgccattatcaacgagccatttaaaactgaagccaataaggggaactttctggagatgaaaaataagttcctggcccggaggttcaagctcctggagcaggcgctggtgattgaggagcagctgcggcgggcggcctacctgaacctgtcgcaggagccggcgcaccccgccatggccctccacgcccgcttcgccgaggccgagtgcctggccgagagccaccagcacctctccaaggagtcgctggcggggaacaagccggccaacgccgtcctgcacaaggttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggcctacccgccgggtccctacgctacacctccggggtacggggcggccttcagcgccgcacccgtaggggccctggccgccgcaggcgccaattacagccagatgcctgcagggtccttcatcacagccgccaccaacggccctccagtgcttgtgaagaaggagaaggaaatggtgggggcattggtgtcagacgggctggatcggaaggagccccgagccggggaggtgatctgtatagacgactga

SEQ ID NO: 16911 - DNA, 148 bp, Artificial Sequence
  Synthetic polypeptide
ggccaggcgcagtgactcacacctgtcatcccagcactttgagaggctgtgatccaggcagatcacggggttaggagttcaagaccagcctggccaatatggtcctgtcggcggcaagcgagcagcctgcgcaggtggctggagctga

SEQ ID NO: 16912 - DNA, 318 bp, Artificial Sequence
  Synthetic polypeptide
ggccaggcgcagtgactcacacctgtcatcccagcactttgagaggctgtgatccaggcagatcacggggttaggagttcaagaccagcctggccaatatggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctag

SEQ ID NO: 16913 - DNA, 703 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagatgggatccctgcctgtaccatcctgagcccttaa

SEQ ID NO: 16914 - DNA, 748 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttga

SEQ ID NO: 16915 - DNA, 691 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagataactctcttcactattcctag

SEQ ID NO: 16916 - DNA, 748 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctag

SEQ ID NO: 16917 - DNA, 1039 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctag

SEQ ID NO: 16918 - DNA, 306 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcc

SEQ ID NO: 16919 - DNA, 441 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgcccccctcagggaagcaggagctgcagcccttcgaccgcaacct

SEQ ID NO: 16920 - DNA, 380 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaagg

SEQ ID NO: 16921 - DNA, 398 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgc

SEQ ID NO: 16922 - DNA, 745 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataa

SEQ ID NO: 16923 - DNA, 188 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctga

SEQ ID NO: 16924 - DNA, 172 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaaggtacaagcctgggatggggaggggcccagtga

SEQ ID NO: 16925 - DNA, 442 bp, Artificial Sequence
  Synthetic polypeptide
ctgtatctgccattctttggctgggtggccctggcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatg

SEQ ID NO: 16926 - DNA, 811 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16927 - DNA, 754 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16928 - DNA, 376 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggttcttctagctcctcttcttcctcctcgtcctcctcctcttcctccagtgatggccggaagaagcgggggaagtacaaggacaagaggaggaagaagaagaagaagaggaagaagctga

SEQ ID NO: 16929 - DNA, 650 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagcctcaccttctccctgcatcacagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcacca

SEQ ID NO: 16930 - DNA, 745 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaagagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaaggtgggtgtggcccctctgcctgccatccgcccccagctctgtttgtga

SEQ ID NO: 16931 - DNA, 787 bp, Artificial Sequence
  Synthetic polypeptide
atggcagaggggtgaatggcagggccaggaaccaggctgcccgggttcccattctgcttctgccacttccagctgtgtggctttagcccgcggcgccatggctcacgtcggctcccgcaagcgctcgaggagtcgcagccggtcccggggacgggggtcggaaaagagaaagaagaagagcaggaaagacacctcgaggaactgctcggcctccacatcccaaggtcgcaaggccagcacggcccctggggcggaggagagaagcaagcagaaggcccggaggagaacaagatccagctcctcctcctcttcttccagttcttctagctcctcttcttcctcctcgtcctcctcctcttcctccagtgatggccggaagaagcgggggaagtacaaggacaagaggaggaagaagaagaagaagaggaagaagctgaagaagaagggcaaggagaaggcggaagcacagcaggtggaggctctgccgggcccctcgctggaccagtggcaccgatcagctggggaggaagaggatggcccagtcctgacggatgagcagaagtcccgaatccaggccatgaagcccatgaccaaggaggagtgggatgcccggcagagcatcatccgcaaggtggtggaccctgagacggggcgcaccaggcttattaagggagatggcgaggtcctagaggaaatcgtaaccaaagaacgacacagagagatcaacaagcaagccacccgaggggactgcctggccttccagatgcgagctgggttgcttccctga

SEQ ID NO: 16932 - DNA, 261 bp, Artificial Sequence
  Synthetic polypeptide
atcccgacttctccccccagctctgtgccttcgggccttggcttccccactctgggcctgtttcctggtctgtgaaatgggaactcaccccggtgttgttggaagcacccagctcagtgcctggcacaggactcggtgaaatacctggagtgctcagctctcacccagagaggcctgaaaaccgtgttcgacgaggccatccgggccgtgctgtgccctcagcccacgcggcagcagaagcgcgcctgcagcctcctctag

SEQ ID NO: 16933 - DNA, 181 bp, Artificial Sequence
  Synthetic polypeptide
atcccgacttctccccccagctctgtgccttcgggccttggcttccccactctgggcctgtttcctggtctgtgaaatgggaactcaccccggtgttgttggaagcacccagctcagtgcctggcacaggactcggtgaaatacctggagtgctcagctctcacccagagaggcctgaaaa

SEQ ID NO: 16934 - DNA, 1463 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16935 - DNA, 1460 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16936 - DNA, 1415 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataa

SEQ ID NO: 16937 - DNA, 1047 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatcc

SEQ ID NO: 16938 - DNA, 963 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaa

SEQ ID NO: 16939 - DNA, 570 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgt

SEQ ID NO: 16940 - DNA, 440 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatggttactcagacacacatagcagaagctactggctgggtccctggtgatagaaaacgg

SEQ ID NO: 16941 - DNA, 384 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcaccagcaatgg

SEQ ID NO: 16942 - DNA, 376 bp, Artificial Sequence
  Synthetic polypeptide
tgctgtggtttgaatgggttcctccaaaaattcatgttgaaacctaatccctactgtggtggtattaagaggcggggccttttgggaagtgatgaagtcatgagggcttcacccttatgagtggaattagtgcccttataaaagaggttgaagggagcaccctggaccctttctgctattaggatgcaaccagaaggcatcatctttgaagcagagaataaaccctcaccaggcactgaatctgccggcactttcattttggacctctcagcaacctccagaacagtgagcaataaatttctgtgattataagcacaccacagagactaaccagttcaggaagtgttctgattgggagtccatatacccctgcacc

SEQ ID NO: 16943 - DNA, 456 bp, Artificial Sequence
  Synthetic polypeptide
ggctttggaaccagctggatctaggctgtgccacatactacctctttggccttggccacatccctaaactcttggattctgtttcctaagatgtaagatggagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctga

SEQ ID NO: 16944 - DNA, 137 bp, Artificial Sequence
  Synthetic polypeptide
ggctttggaaccagctggatctaggctgtgccacatactacctctttggccttggccacatccctaaactcttggattctgtttcctaagatgtaagatggagagaatcctttcctgtttgcattggaagccgtggt

SEQ ID NO: 16945 - DNA, 562 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaa

SEQ ID NO: 16946 - DNA, 387 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgca

SEQ ID NO: 16947 - DNA, 382 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgac

SEQ ID NO: 16948 - DNA, 367 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacagg

SEQ ID NO: 16949 - DNA, 356 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggagg

SEQ ID NO: 16950 - DNA, 236 bp, Artificial Sequence
  Synthetic polypeptide
agcagagtggttccgagctcaggttctggagtcaggcagacataatttggaattccagccatgtccatttctggtttttggccttgggtacattgatttacgctgctgaacttcagtttcctcttctataagctggggcagtgatagtaacttcctcatcagcctgcttagacgcctggtgactctcatttcgcagcaggccacgctgctggcctccaatgaagcctttaaaaagc

SEQ ID NO: 16951 - DNA, 355 bp, Artificial Sequence
  Synthetic polypeptide
tataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgttggaggaactgcagatgtttacctgggagaagagtgaaaggatgggagggaagaggaaactctgatgaggaagaaagtgcttcagaatctgaactttggaagggtccactaccagagacagatgaaaaatcacaggaagaagaatttgatgagtattttcaggatttgtttctatga

SEQ ID NO: 16952 - DNA, 2087 bp, Artificial Sequence; identical to SEQ ID NO: 9707
  Synthetic polypeptide

SEQ ID NO: 16953 - DNA, 581 bp, Artificial Sequence; identical to SEQ ID NO: 9708
  Synthetic polypeptide

SEQ ID NO: 16954 - DNA, 769 bp, Artificial Sequence; identical to SEQ ID NO: 6486
  Synthetic polypeptide

SEQ ID NO: 16955 - DNA, 1516 bp, Artificial Sequence; identical to SEQ ID NO: 534
  Synthetic polypeptide

SEQ ID NO: 16956 - DNA, 591 bp, Artificial Sequence; identical to SEQ ID NO: 539
  Synthetic polypeptide

SEQ ID NO: 16957 - DNA, 482 bp, Artificial Sequence; identical to SEQ ID NO: 540
  Synthetic polypeptide

SEQ ID NO: 16958 - DNA, 444 bp, Artificial Sequence; identical to SEQ ID NO: 541
  Synthetic polypeptide

SEQ ID NO: 16959 - DNA, 334 bp, Artificial Sequence; identical to SEQ ID NO: 533
  Synthetic polypeptide

SEQ ID NO: 16960 - DNA, 38 bp, Artificial Sequence; identical to SEQ ID NO: 543
  Synthetic polypeptide

SEQ ID NO: 16961 - DNA, 245 bp, Artificial Sequence; identical to SEQ ID NO: 542
  Synthetic polypeptide

SEQ ID NO: 16962 - DNA, 742 bp, Artificial Sequence; identical to SEQ ID NO: 6357
  Synthetic polypeptide

SEQ ID NO: 16963 - DNA, 590 bp, Artificial Sequence; identical to SEQ ID NO: 6358
  Synthetic polypeptide

SEQ ID NO: 16964 - DNA, 577 bp, Artificial Sequence; identical to SEQ ID NO: 6359
  Synthetic polypeptide

SEQ ID NO: 16965 - DNA, 430 bp, Artificial Sequence; identical to SEQ ID NO: 6360
  Synthetic polypeptide

SEQ ID NO: 16966 - DNA, 670 bp, Artificial Sequence; identical to SEQ ID NO: 6361
  Synthetic polypeptide

SEQ ID NO: 16967 - DNA, 2016 bp, Artificial Sequence; identical to SEQ ID NO: 9715
  Synthetic polypeptide

SEQ ID NO: 16968 - DNA, 510 bp, Artificial Sequence; identical to SEQ ID NO: 9716
  Synthetic polypeptide

SEQ ID NO: 16969 - DNA, 163 bp, Artificial Sequence; identical to SEQ ID NO: 480
  Synthetic polypeptide

SEQ ID NO: 16970 - DNA, 104 bp, Artificial Sequence; identical to SEQ ID NO: 481
  Synthetic polypeptide

SEQ ID NO: 16971 - DNA, 330 bp, Artificial Sequence; identical to SEQ ID NO: 6490
  Synthetic polypeptide

SEQ ID NO: 16972 - DNA, 2484 bp, Artificial Sequence; identical to SEQ ID NO: 9884
  Synthetic polypeptide

SEQ ID NO: 16973 - DNA, 871 bp, Artificial Sequence; identical to SEQ ID NO: 437
  Synthetic polypeptide

SEQ ID NO: 16974 - DNA, 421 bp, Artificial Sequence; identical to SEQ ID NO: 441
  Synthetic polypeptide

SEQ ID NO: 16975 - DNA, 638 bp, Artificial Sequence; identical to SEQ ID NO: 442
  Synthetic polypeptide

SEQ ID NO: 16976 - DNA, 337 bp, Artificial Sequence; identical to SEQ ID NO: 443
  Synthetic polypeptide

SEQ ID NO: 16977 - DNA, 80 bp, Artificial Sequence; identical to SEQ ID NO: 6364
  Synthetic polypeptide

SEQ ID NO: 16978 - DNA, 217 bp, Artificial Sequence; identical to SEQ ID NO: 6365
  Synthetic polypeptide

SEQ ID NO: 16979 - DNA, 337 bp, Artificial Sequence; identical to SEQ ID NO: 6393
  Synthetic polypeptide

SEQ ID NO: 16980 - DNA, 382 bp, Artificial Sequence; identical to SEQ ID NO: 434
  Synthetic polypeptide

SEQ ID NO: 16981 - DNA, 67 bp, Artificial Sequence; identical to SEQ ID NO: 16124
  Synthetic polypeptide

SEQ ID NO: 16982 - DNA, 792 bp, Artificial Sequence; identical to SEQ ID NO: 6418
  Synthetic polypeptide

SEQ ID NO: 16983 - DNA, 369 bp, Artificial Sequence; identical to SEQ ID NO: 6419
  Synthetic polypeptide

SEQ ID NO: 16984 - DNA, 249 bp, Artificial Sequence; identical to SEQ ID NO: 6420
  Synthetic polypeptide

SEQ ID NO: 16985 - DNA, 369 bp, Artificial Sequence; identical to SEQ ID NO: 6421
  Synthetic polypeptide

SEQ ID NO: 16986 - DNA, 843 bp, Artificial Sequence; identical to SEQ ID NO: 6422
  Synthetic polypeptide

SEQ ID NO: 16987 - DNA, 943 bp, Artificial Sequence; identical to SEQ ID NO: 9889
  Synthetic polypeptide

SEQ ID NO: 16988 - DNA, 427 bp, Artificial Sequence; identical to SEQ ID NO: 573
  Synthetic polypeptide

SEQ ID NO: 16989 - DNA, 1883 bp, Artificial Sequence; identical to SEQ ID NO: 6345
  Synthetic polypeptide

SEQ ID NO: 16990 - DNA, 665 bp, Artificial Sequence; identical to SEQ ID NO: 6374
  Synthetic polypeptide

SEQ ID NO: 16991 - DNA, 518 bp, Artificial Sequence; identical to SEQ ID NO: 6375
  Synthetic polypeptide

SEQ ID NO: 16992 - DNA, 560 bp, Artificial Sequence; identical to SEQ ID NO: 6322
  Synthetic polypeptide

SEQ ID NO: 16993 - DNA, 893 bp, Artificial Sequence; identical to SEQ ID NO: 12957
  Synthetic polypeptide

SEQ ID NO: 16994 - DNA, 959 bp, Artificial Sequence; identical to SEQ ID NO: 12958
  Synthetic polypeptide

SEQ ID NO: 16995 - DNA, 1028 bp, Artificial Sequence; identical to SEQ ID NO: 12959
  Synthetic polypeptide

SEQ ID NO: 16996 - DNA, 887 bp, Artificial Sequence; identical to SEQ ID NO: 12960
  Synthetic polypeptide

SEQ ID NO: 16997 - DNA, 851 bp, Artificial Sequence; identical to SEQ ID NO: 12778
  Synthetic polypeptide

SEQ ID NO: 16998 - DNA, 815 bp, Artificial Sequence; identical to SEQ ID NO: 12782
  Synthetic polypeptide

SEQ ID NO: 16999 - DNA, 833 bp, Artificial Sequence; identical to SEQ ID NO: 12781
  Synthetic polypeptide

SEQ ID NO: 17000 - DNA, 2157 bp, Artificial Sequence; identical to SEQ ID NO: 6426
  Synthetic polypeptide

SEQ ID NO: 17001 - DNA, 799 bp, Artificial Sequence; identical to SEQ ID NO: 6427
  Synthetic polypeptide

SEQ ID NO: 17002 - DNA, 336 bp, Artificial Sequence; identical to SEQ ID NO: 6428
  Synthetic polypeptide

SEQ ID NO: 17003 - DNA, 540 bp, Artificial Sequence; identical to SEQ ID NO: 6513
  Synthetic polypeptide

SEQ ID NO: 17004 - DNA, 651 bp, Artificial Sequence; identical to SEQ ID NO: 6514
  Synthetic polypeptide

SEQ ID NO: 17005 - DNA, 569 bp, Artificial Sequence; identical to SEQ ID NO: 6515
  Synthetic polypeptide

SEQ ID NO: 17006 - DNA, 152 bp, Artificial Sequence; identical to SEQ ID NO: 6516
  Synthetic polypeptide

SEQ ID NO: 17007 - DNA, 181 bp, Artificial Sequence
  Synthetic polypeptide
gtggtggtgaggaaggatccctggacctgagaggtctgacttgggttctggtctcagccatccacttatcagttgtggaaccttgggcccaggctttggtgcagtacctggaggagcccctcacccaagtggcggcatcttaacggcattggtggaagctggggtcagaaaagagaaatga

SEQ ID NO: 17008 - DNA, 143 bp, Artificial Sequence
  Synthetic polypeptide
gtggtggtgaggaaggatccctggacctgagaggtctgacttgggttctggtctcagccatccacttatcagttgtggaaccttgggcccaggctttggtgcagtacctggaggagcccctcacccaagtggcggcatcttaa

SEQ ID NO: 17009 - DNA, 259 bp, Artificial Sequence; identical to SEQ ID NO: 7895
  Synthetic polypeptide

SEQ ID NO: 17010 - DNA, 310 bp, Artificial Sequence; identical to SEQ ID NO: 7896
  Synthetic polypeptide

SEQ ID NO: 17011 - DNA, 586 bp, Artificial Sequence
  Synthetic polypeptide
ctcctggaatcttagtttcttcatttgcaaaaagtagacaggaacttctcccctgcggggttgcaatgggaattggagaaaatatatttcaagtgccttgcgcgatgcccggcaccgaggcacttggcggcactcaatatctgggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatag

SEQ ID NO: 17012 - DNA, 236 bp, Artificial Sequence; identical to SEQ ID NO: 9570
  Synthetic polypeptide

SEQ ID NO: 17013 - DNA, 542 bp, Artificial Sequence; identical to SEQ ID NO: 9571
  Synthetic polypeptide

SEQ ID NO: 17014 - DNA, 1214 bp, Artificial Sequence; identical to SEQ ID NO: 9572
  Synthetic polypeptide

SEQ ID NO: 17015 - DNA, 144 bp, Artificial Sequence; identical to SEQ ID NO: 9573
  Synthetic polypeptide

SEQ ID NO: 17016 - DNA, 515 bp, Artificial Sequence; identical to SEQ ID NO: 9574
  Synthetic polypeptide

SEQ ID NO: 17017 - DNA, 148 bp, Artificial Sequence; identical to SEQ ID NO: 6388
  Synthetic polypeptide

SEQ ID NO: 17018 - DNA, 1100 bp, Artificial Sequence; identical to SEQ ID NO: 6389
  Synthetic polypeptide

SEQ ID NO: 17019 - DNA, 464 bp, Artificial Sequence; identical to SEQ ID NO: 6390
  Synthetic polypeptide

SEQ ID NO: 17020 - DNA, 280 bp, Artificial Sequence; identical to SEQ ID NO: 6391
  Synthetic polypeptide

SEQ ID NO: 17021 - DNA, 374 bp, Artificial Sequence; identical to SEQ ID NO: 10336
  Synthetic polypeptide

SEQ ID NO: 17022 - DNA, 405 bp, Artificial Sequence; identical to SEQ ID NO: 7860
  Synthetic polypeptide

SEQ ID NO: 17023 - DNA, 274 bp, Artificial Sequence; identical to SEQ ID NO: 7861
  Synthetic polypeptide

SEQ ID NO: 17024 - DNA, 196 bp, Artificial Sequence; identical to SEQ ID NO: 7862
  Synthetic polypeptide

SEQ ID NO: 17025 - DNA, 268 bp, Artificial Sequence; identical to SEQ ID NO: 7863
  Synthetic polypeptide

SEQ ID NO: 17026 - DNA, 186 bp, Artificial Sequence; identical to SEQ ID NO: 7864
  Synthetic polypeptide

SEQ ID NO: 17027 - DNA, 522 bp, Artificial Sequence
  Synthetic polypeptide
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17028 - DNA, 603 bp, Artificial Sequence
  Synthetic polypeptide
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17029 - DNA, 321 bp, Artificial Sequence
  Synthetic polypeptide
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatggcaaatcgaagggagagtggttga

SEQ ID NO: 17030 - DNA, 359 bp, Artificial Sequence
  Synthetic polypeptide
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggta

SEQ ID NO: 17031 - DNA, 347 bp, Artificial Sequence
  Synthetic polypeptide
aaaatgttcctacgctccctttcagcagttgcatgcccaggtatctgtcctagagagtcactccagcatgtgcacatagcacagaccgggacacagtaccatgacaccagtgaacagtctgaaaccactgaggtctgtcagcgtagttatggctaaagaccagtgtatcctcacgatggaatatcatgcagcaatttaaaagaacaagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttga

SEQ ID NO: 17032 - DNA, 1365 bp, Artificial Sequence; identical to SEQ ID NO: 8252
  Synthetic polypeptide

SEQ ID NO: 17033 - DNA, 797 bp, Artificial Sequence; identical to SEQ ID NO: 12733
  Synthetic polypeptide

SEQ ID NO: 17034 - DNA, 527 bp, Artificial Sequence; identical to SEQ ID NO: 7665
  Synthetic polypeptide

SEQ ID NO: 17035 - DNA, 773 bp, Artificial Sequence; identical to SEQ ID NO: 10251
  Synthetic polypeptide

SEQ ID NO: 17036 - DNA, 595 bp, Artificial Sequence; identical to SEQ ID NO: 12829
  Synthetic polypeptide

SEQ ID NO: 17037 - DNA, 523 bp, Artificial Sequence; identical to SEQ ID NO: 8925
  Synthetic polypeptide

SEQ ID NO: 17038 - DNA, 853 bp, Artificial Sequence; identical to SEQ ID NO: 8074
  Synthetic polypeptide

SEQ ID NO: 17039 - DNA, 545 bp, Artificial Sequence; identical to SEQ ID NO: 7336
  Synthetic polypeptide

SEQ ID NO: 17040 - DNA, 282 bp, Artificial Sequence; identical to SEQ ID NO: 7621
  Synthetic polypeptide

SEQ ID NO: 17041 - DNA, 348 bp, Artificial Sequence; identical to SEQ ID NO: 6363
  Synthetic polypeptide

SEQ ID NO: 17042 - DNA, 2448 bp, Artificial Sequence; identical to SEQ ID NO: 6618
  Synthetic polypeptide

SEQ ID NO: 17043 - DNA, 1543 bp, Artificial Sequence; identical to SEQ ID NO: 6619
  Synthetic polypeptide

SEQ ID NO: 17044 - DNA, 1468 bp, Artificial Sequence; identical to SEQ ID NO: 6620
  Synthetic polypeptide

SEQ ID NO: 17045 - DNA, 2672 bp, Artificial Sequence; identical to SEQ ID NO: 6621
  Synthetic polypeptide

SEQ ID NO: 17046 - DNA, 1767 bp, Artificial Sequence; identical to SEQ ID NO: 6622
  Synthetic polypeptide

SEQ ID NO: 17047 - DNA, 1692 bp, Artificial Sequence; identical to SEQ ID NO: 6623
  Synthetic polypeptide

SEQ ID NO: 17048 - DNA, 369 bp, Artificial Sequence; identical to SEQ ID NO: 6492
  Synthetic polypeptide

SEQ ID NO: 17049 - DNA, 164 bp, Artificial Sequence; identical to SEQ ID NO: 831
  Synthetic polypeptide

SEQ ID NO: 17050 - DNA, 193 bp, Artificial Sequence; identical to SEQ ID NO: 834
  Synthetic polypeptide

SEQ ID NO: 17051 - DNA, 331 bp, Artificial Sequence; identical to SEQ ID NO: 7504
  Synthetic polypeptide

SEQ ID NO: 17052 - DNA, 858 bp, Artificial Sequence
  Synthetic polypeptide
gaccgggcgcggtggctcacgcctataatgccagcactttgggaggctgaggcgggcggatcgcgaggtccggagatcgggaccatcctggctaacatgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17053 - DNA, 939 bp, Artificial Sequence
  Synthetic polypeptide
gaccgggcgcggtggctcacgcctataatgccagcactttgggaggctgaggcgggcggatcgcgaggtccggagatcgggaccatcctggctaacatgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17054 - DNA, 1052 bp, Artificial Sequence; identical to SEQ ID NO: 447
  Synthetic polypeptide

SEQ ID NO: 17055 - DNA, 1118 bp, Artificial Sequence; identical to SEQ ID NO: 448
  Synthetic polypeptide

SEQ ID NO: 17056 - DNA, 67 bp, Artificial Sequence; identical to SEQ ID NO: 16124
  Synthetic polypeptide

SEQ ID NO: 17057 - DNA, 325 bp, Artificial Sequence
  Synthetic polypeptide
atatctaattcattagccattctattcagctctccctccagaatagatcccaaatccaaccactttgtacaacctctgcagttcctttggacctttgttggcccaggatgtggctttgtttgagatgaatcagtcggattcaaaagaagtggacagttcagaagagagttcacaagacagttcagagaacagttcagaatcagaagacgaagatgacagcatcccatctgaagtcaccatagataacattaagcttcccaattctgaaggtggaaaaggcaagattgaagttttggacagtccagcaagtaaaaaaaagaaatag

SEQ ID NO: 17058 - DNA, 108 bp, Artificial Sequence
  Synthetic polypeptide
atatctaattcattagccattctattcagctctccctccagaatagatcccaaatccaaccactttgtacaacctctgcagttcctttggacctttgttggcccagga

SEQ ID NO: 17059 - DNA, 854 bp, Artificial Sequence; identical to SEQ ID NO: 6577
  Synthetic polypeptide

SEQ ID NO: 17060 - DNA, 463 bp, Artificial Sequence; identical to SEQ ID NO: 588
  Synthetic polypeptide

SEQ ID NO: 17061 - DNA, 3055 bp, Artificial Sequence; identical to SEQ ID NO: 709
  Synthetic polypeptide

SEQ ID NO: 17062 - DNA, 3058 bp, Artificial Sequence; identical to SEQ ID NO: 710
  Synthetic polypeptide

SEQ ID NO: 17063 - DNA, 763 bp, Artificial Sequence; identical to SEQ ID NO: 606
  Synthetic polypeptide

SEQ ID NO: 17064 - DNA, 2471 bp, Artificial Sequence; identical to SEQ ID NO: 576
  Synthetic polypeptide

SEQ ID NO: 17065 - DNA, 389 bp, Artificial Sequence; identical to SEQ ID NO: 12456
  Synthetic polypeptide

SEQ ID NO: 17066 - DNA, 695 bp, Artificial Sequence; identical to SEQ ID NO: 12457
  Synthetic polypeptide

SEQ ID NO: 17067 - DNA, 1367 bp, Artificial Sequence; identical to SEQ ID NO: 12458
  Synthetic polypeptide

SEQ ID NO: 17068 - DNA, 297 bp, Artificial Sequence; identical to SEQ ID NO: 12459
  Synthetic polypeptide

SEQ ID NO: 17069 - DNA, 668 bp, Artificial Sequence; identical to SEQ ID NO: 12460
  Synthetic polypeptide

SEQ ID NO: 17070 - DNA, 1084 bp, Artificial Sequence; identical to SEQ ID NO: 580
  Synthetic polypeptide

SEQ ID NO: 17071 - DNA, 535 bp, Artificial Sequence
  Synthetic polypeptide
gcctgacgcggtggctcatgcctgtaatcccagcactttcggaggccaaggtgggaggatcgcttgagcccaggagttggagaccagcctgggcaacatggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactga

SEQ ID NO: 17072 - DNA, 853 bp, Artificial Sequence; identical to SEQ ID NO: 10246
  Synthetic polypeptide

SEQ ID NO: 17073 - DNA, 423 bp, Artificial Sequence; identical to SEQ ID NO: 6550
  Synthetic polypeptide

SEQ ID NO: 17074 - DNA, 1022 bp, Artificial Sequence; identical to SEQ ID NO: 590
  Synthetic polypeptide

SEQ ID NO: 17075 - DNA, 347 bp, Artificial Sequence; identical to SEQ ID NO: 591
  Synthetic polypeptide

SEQ ID NO: 17076 - DNA, 1109 bp, Artificial Sequence; identical to SEQ ID NO: 592
  Synthetic polypeptide

SEQ ID NO: 17077 - DNA, 85 bp, Artificial Sequence; identical to SEQ ID NO: 601
  Synthetic polypeptide

SEQ ID NO: 17078 - DNA, 269 bp, Artificial Sequence; identical to SEQ ID NO: 600
  Synthetic polypeptide

SEQ ID NO: 17079 - DNA, 370 bp, Artificial Sequence; identical to SEQ ID NO: 6522
  Synthetic polypeptide

SEQ ID NO: 17080 - DNA, 707 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgcctt

SEQ ID NO: 17081 - DNA, 1013 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagta

SEQ ID NO: 17082 - DNA, 1685 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaa

SEQ ID NO: 17083 - DNA, 615 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctg

SEQ ID NO: 17084 - DNA, 986 bp, Artificial Sequence
  Synthetic polypeptide
gtactcttgaatacaagtttcttataattttaagattgtattatagcactgagtaaacaatttcagaactctaatttttaaaaagtcataaaattgttaactcaacatcaagcaaaacaactaattacattggactaatgtaattttaataacttttttgtttaaaatattgctgattctttttatgttttgctttacagagttaaggaaaatgtttgttctgttaagctttacagaaatgggtaaagtatacttttttgaacaaaattgaaacattcacttttctctctacctgattgatcctgaatttggaaactatgagtatttctattttatggcaaaatagttatttgaatcagttcattaagaatctgttcccttttgccacagaacacagttggagactctggttattttaccaaggctttgactgaaatgccatattttcagatgtgaccagacagctttaagaaactgaggttgatattatgaagcccataggagcttttggaaaaactggtctaatatcctaaatacacggttcacataatgggcttgtggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagtatgtaaacagaacatggacgttttgttctcatttcgtgatggagactgcagtaaaggattcttcctggtctctctattggtggaaatag

SEQ ID NO: 17085 - DNA, 829 bp, Artificial Sequence; identical to SEQ ID NO: 624
  Synthetic polypeptide

SEQ ID NO: 17086 - DNA, 2825 bp, Artificial Sequence; identical to SEQ ID NO: 6727
  Synthetic polypeptide

SEQ ID NO: 17087 - DNA, 1331 bp, Artificial Sequence; identical to SEQ ID NO: 550
  Synthetic polypeptide

SEQ ID NO: 17088 - DNA, 1028 bp, Artificial Sequence; identical to SEQ ID NO: 551
  Synthetic polypeptide

SEQ ID NO: 17089 - DNA, 1295 bp, Artificial Sequence; identical to SEQ ID NO: 553
  Synthetic polypeptide

SEQ ID NO: 17090 - DNA, 1322 bp, Artificial Sequence; identical to SEQ ID NO: 554
  Synthetic polypeptide

SEQ ID NO: 17091 - DNA, 1013 bp, Artificial Sequence; identical to SEQ ID NO: 555
  Synthetic polypeptide

SEQ ID NO: 17092 - DNA, 718 bp, Artificial Sequence; identical to SEQ ID NO: 12403
  Synthetic polypeptide

SEQ ID NO: 17093 - DNA, 616 bp, Artificial Sequence; identical to SEQ ID NO: 12404
  Synthetic polypeptide

SEQ ID NO: 17094 - DNA, 287 bp, Artificial Sequence; identical to SEQ ID NO: 7101
  Synthetic polypeptide

SEQ ID NO: 17095 - DNA, 281 bp, Artificial Sequence; identical to SEQ ID NO: 7102
  Synthetic polypeptide

SEQ ID NO: 17096 - DNA, 701 bp, Artificial Sequence; identical to SEQ ID NO: 658
  Synthetic polypeptide

SEQ ID NO: 17097 - DNA, 866 bp, Artificial Sequence
  Synthetic polypeptide
caatagtcccatcccccatgttatccacagtttaattttccagtttcagttactcatggtcaactgtggttcgaattttatcctctcacttcatcacaaaaagaaagatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggtccctcacctataa

SEQ ID NO: 17098 - DNA, 947 bp, Artificial Sequence
  Synthetic polypeptide
caatagtcccatcccccatgttatccacagtttaattttccagtttcagttactcatggtcaactgtggttcgaattttatcctctcacttcatcacaaaaagaaagatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctag

SEQ ID NO: 17099 - DNA, 167 bp, Artificial Sequence
  Synthetic polypeptide
ccagtgccctggtggactctcgatgatactagtcgggaaagaggttaaagaagacacgcaagtatgatatcatcaccactccagcagagcgagtggaaatggcgccactaaatgaagaggatgatgaagatgaggactccacagtattcgacatcaaatacaggtaa

SEQ ID NO: 17100 - DNA, 1765 bp, Artificial Sequence; identical to SEQ ID NO: 6684
  Synthetic polypeptide

SEQ ID NO: 17101 - DNA, 1588 bp, Artificial Sequence
  Synthetic polypeptide
ccactgccaccaagccaagccaccaccaaccctaacctgcctagtccctctgctcctgctctggcaccccacaggtctttcctacatggagtggggaccaccaggtcatgtcagtgtcctgcttacacccttcagtgcttcctggtgctgcctgatgcacctgagaaaatgccagccctcagccatctcctcttcccaggatctccctgcatctcaagccctggctttgtagcagtttccatgggttctttctattccttgaagaccccgaacttgtctcctagaactttgcattttctgttccctctgcatagaatacccttctccagatcttcccacagatgcctcctggcaattcagatctctgttctgttctaatgtcaactcctcaaggaagtcctcttgatcacctcagctaaagtggccctcactttcctcaccacccccacaccccagttgccatcccagcatcttcctttactttcttcatagtacatatcactgtcgagatggcctgttttattcatttgtgacatctgtgttgtcaccctccctagttccttgagggcagggcattgcctgtcaggtgcacagctgtctcctagcatgtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtggggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtga

SEQ ID NO: 17102 - DNA, 382 bp, Artificial Sequence; identical to SEQ ID NO: 434
  Synthetic polypeptide

SEQ ID NO: 17103 - DNA, 259 bp, Artificial Sequence; identical to SEQ ID NO: 7895
  Synthetic polypeptide

SEQ ID NO: 17104 - DNA, 310 bp, Artificial Sequence; identical to SEQ ID NO: 7896
  Synthetic polypeptide

SEQ ID NO: 17105 - DNA, 560 bp, Artificial Sequence; identical to SEQ ID NO: 6322
  Synthetic polypeptide

SEQ ID NO: 17106 - DNA, 742 bp, Artificial Sequence; identical to SEQ ID NO: 6357
  Synthetic polypeptide

SEQ ID NO: 17107 - DNA, 590 bp, Artificial Sequence; identical to SEQ ID NO: 6358
  Synthetic polypeptide

SEQ ID NO: 17108 - DNA, 577 bp, Artificial Sequence; identical to SEQ ID NO: 6359
  Synthetic polypeptide

SEQ ID NO: 17109 - DNA, 430 bp, Artificial Sequence; identical to SEQ ID NO: 6360
  Synthetic polypeptide

SEQ ID NO: 17110 - DNA, 670 bp, Artificial Sequence; identical to SEQ ID NO: 6361
  Synthetic polypeptide

SEQ ID NO: 17111 - DNA, 1516 bp, Artificial Sequence; identical to SEQ ID NO: 534
  Synthetic polypeptide

SEQ ID NO: 17112 - DNA, 591 bp, Artificial Sequence; identical to SEQ ID NO: 539
  Synthetic polypeptide

SEQ ID NO: 17113 - DNA, 482 bp, Artificial Sequence; identical to SEQ ID NO: 540
  Synthetic polypeptide

SEQ ID NO: 17114 - DNA, 444 bp, Artificial Sequence; identical to SEQ ID NO: 541
  Synthetic polypeptide

SEQ ID NO: 17115 - DNA, 334 bp, Artificial Sequence; identical to SEQ ID NO: 533
  Synthetic polypeptide

SEQ ID NO: 17116 - DNA, 38 bp, Artificial Sequence; identical to SEQ ID NO: 543
  Synthetic polypeptide

SEQ ID NO: 17117 - DNA, 245 bp, Artificial Sequence; identical to SEQ ID NO: 542
  Synthetic polypeptide

SEQ ID NO: 17118 - DNA, 792 bp, Artificial Sequence; identical to SEQ ID NO: 6418
  Synthetic polypeptide

SEQ ID NO: 17119 - DNA, 369 bp, Artificial Sequence; identical to SEQ ID NO: 6419
  Synthetic polypeptide

SEQ ID NO: 17120 - DNA, 249 bp, Artificial Sequence; identical to SEQ ID NO: 6420
  Synthetic polypeptide

SEQ ID NO: 17121 - DNA, 369 bp, Artificial Sequence; identical to SEQ ID NO: 6421
  Synthetic polypeptide

SEQ ID NO: 17122 - DNA, 843 bp, Artificial Sequence; identical to SEQ ID NO: 6422
  Synthetic polypeptide

SEQ ID NO: 17123 - DNA, 871 bp, Artificial Sequence; identical to SEQ ID NO: 437
  Synthetic polypeptide

SEQ ID NO: 17124 - DNA, 421 bp, Artificial Sequence; identical to SEQ ID NO: 441
  Synthetic polypeptide

SEQ ID NO: 17125 - DNA, 638 bp, Artificial Sequence; identical to SEQ ID NO: 442
  Synthetic polypeptide

SEQ ID NO: 17126 - DNA, 337 bp, Artificial Sequence; identical to SEQ ID NO: 443
  Synthetic polypeptide

SEQ ID NO: 17127 - DNA, 163 bp, Artificial Sequence; identical to SEQ ID NO: 480
  Synthetic polypeptide

SEQ ID NO: 17128 - DNA, 104 bp, Artificial Sequence; identical to SEQ ID NO: 481
  Synthetic polypeptide

SEQ ID NO: 17129 - DNA, 337 bp, Artificial Sequence; identical to SEQ ID NO: 6393
  Synthetic polypeptide

SEQ ID NO: 17130 - DNA, 1004 bp, Artificial Sequence; identical to SEQ ID NO: 8920
  Synthetic polypeptide

SEQ ID NO: 17131 - DNA, 887 bp, Artificial Sequence; identical to SEQ ID NO: 8921
  Synthetic polypeptide

SEQ ID NO: 17132 - DNA, 80 bp, Artificial Sequence; identical to SEQ ID NO: 6364
  Synthetic polypeptide

SEQ ID NO: 17133 - DNA, 217 bp, Artificial Sequence; identical to SEQ ID NO: 6365
  Synthetic polypeptide

SEQ ID NO: 17134 - DNA, 763 bp, Artificial Sequence; identical to SEQ ID NO: 606
  Synthetic polypeptide

SEQ ID NO: 17135 - DNA, 1133 bp, Artificial Sequence; identical to SEQ ID NO: 7332
  Synthetic polypeptide

SEQ ID NO: 17136 - DNA, 1172 bp, Artificial Sequence; identical to SEQ ID NO: 7333
  Synthetic polypeptide

SEQ ID NO: 17137 - DNA, 322 bp, Artificial Sequence; identical to SEQ ID NO: 14839
  Synthetic polypeptide

SEQ ID NO: 17138 - DNA, 181 bp, Artificial Sequence; identical to SEQ ID NO: 17007
  Synthetic polypeptide

SEQ ID NO: 17139 - DNA, 143 bp, Artificial Sequence; identical to SEQ ID NO: 17008
  Synthetic polypeptide

SEQ ID NO: 17140 - DNA, 1409 bp, Artificial Sequence; identical to SEQ ID NO: 14549
  Synthetic polypeptide

SEQ ID NO: 17141 - DNA, 1463 bp, Artificial Sequence; identical to SEQ ID NO: 14550
  Synthetic polypeptide

SEQ ID NO: 17142 - DNA, 1667 bp, Artificial Sequence; identical to SEQ ID NO: 14551
  Synthetic polypeptide

SEQ ID NO: 17143 - DNA, 1328 bp, Artificial Sequence; identical to SEQ ID NO: 14552
  Synthetic polypeptide

SEQ ID NO: 17144 - DNA, 1406 bp, Artificial Sequence; identical to SEQ ID NO: 14553
  Synthetic polypeptide

SEQ ID NO: 17145 - DNA, 1481 bp, Artificial Sequence; identical to SEQ ID NO: 14554
  Synthetic polypeptide

SEQ ID NO: 17146 - DNA, 1352 bp, Artificial Sequence; identical to SEQ ID NO: 14555
  Synthetic polypeptide

SEQ ID NO: 17147 - DNA, 1307 bp, Artificial Sequence; identical to SEQ ID NO: 14556
  Synthetic polypeptide

SEQ ID NO: 17148 - DNA, 1562 bp, Artificial Sequence; identical to SEQ ID NO: 14557
  Synthetic polypeptide

SEQ ID NO: 17149 - DNA, 2157 bp, Artificial Sequence; identical to SEQ ID NO: 6426
  Synthetic polypeptide

SEQ ID NO: 17150 - DNA, 799 bp, Artificial Sequence; identical to SEQ ID NO: 6427
  Synthetic polypeptide

SEQ ID NO: 17151 - DNA, 336 bp, Artificial Sequence; identical to SEQ ID NO: 6428
  Synthetic polypeptide

SEQ ID NO: 17152 - DNA, 665 bp, Artificial Sequence; identical to SEQ ID NO: 6374
  Synthetic polypeptide

SEQ ID NO: 17153 - DNA, 518 bp, Artificial Sequence; identical to SEQ ID NO: 6375
  Synthetic polypeptide

SEQ ID NO: 17154 - DNA, 572 bp, Artificial Sequence
  Synthetic polypeptide
gctgggcacagtggctcaagcctgtaatcctagcactttgggaggccgaggtggcaggatcacttgaacccaggagttcaaaaccagcctggacggaccagcaggctgaggccaggtcctacctcagcgaagagatgatcgctgagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggcagcggcaccatcgacttcgaggagttcttggtcatgatggtgcgccagatgaaagaggacgcgaaagggaagagcgaggaggagctggccgagtgcttccgcatcttcgacaggaatgcagacggctacatcgacccggaggagctggctgagattttcagggcctccggggagcacgtgacggacgaggagatcgaatctctgatgaaagacggcgacaagaacaacgacggccgcattgacttcgacgagttcctgaagatgatggagggcgtgcagtaa

SEQ ID NO: 17155 - DNA, 1033 bp, Artificial Sequence; identical to SEQ ID NO: 7576
  Synthetic polypeptide

SEQ ID NO: 17156 - DNA, 1048 bp, Artificial Sequence; identical to SEQ ID NO: 7577
  Synthetic polypeptide

SEQ ID NO: 17157 - DNA, 1883 bp, Artificial Sequence; identical to SEQ ID NO: 6345
  Synthetic polypeptide

SEQ ID NO: 17158 - DNA, 422 bp, Artificial Sequence
  Synthetic polypeptide
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 17159 - DNA, 470 bp, Artificial Sequence
  Synthetic polypeptide
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagaggatcgctgcagagcagagcagtagattggcaaaatataggacactacgaacagcacattag

SEQ ID NO: 17160 - DNA, 326 bp, Artificial Sequence
  Synthetic polypeptide
gcacggggcttggcaacatggctgatgtggtcatcaagttccctgaggaagaagctccctcgactgtcttgtcccagaaccttttcactccaaaacaggaaattcagtggatccggattggtgccaatgtctccaacttcacttttgctcctagcacgattatatttcacctgggacatgctgctatgctgggactcatgtatgtctactggactcagctcaacatgttccagaccttgaagtacctggccatcctgggcagtgtgacgtttctggctggcaatcggatgctggcccagcaggcagtcaagagaacagcacattag

SEQ ID NO: 17161 - DNA, 395 bp, Artificial Sequence
  Synthetic polypeptide
gcacggggcttggcaacatggctgatgtggtcatcaagttccctgaggaagaagctccctcgactgtcttgtcccagaaccttttcactccaaaacaggaaattcagcacctgttccgcgagcctgagaagaggccccccaccgtggtgtccaatacattcactgccctgatcctctcgccgttgcttctgctcttcgctctgtggatccggattggtgccaatgtctccaacttcacttttgctcctagcacgattatatttcacctgggacatgctgaacagcacattagttccagaagaaagatggaaattctgaaaactgaatgtcaagaaaaggagtcaagaacaattcacagtatgagaagaaaaatggaaaaaaaaaactttatttaa

SEQ ID NO: 17162 - DNA, 751 bp, Artificial Sequence
  Synthetic polypeptide
tgggcaaagaacttgaatagacatttctccagagaagatacacagatggccaataagcccatgaaagatgcgccaagccgttagtcattagggaaatacgaatcaagacccaatgagatactacttttacacatactaggatggctattcaaaaacaaaaacaaaagcaaaatagcaagtgttggcaaggatgtggagacatcagaatccctgtgctttgccgctgggggtgtgaaatggtgcagccactgtggaagacagtatgacagctcctcagaaggttcaacatagaatcaccagagaagcataaaccccaaagaggtgaaacagggacccaaatggatgcttttctatgaatattcatggcagcacctttcacagtggccaaaaggtggaaatgactcaagtgtgctccagcagaggaatgagtaaacaaatgtgttacaagcacacaacagaatcttactcagccatgaaaaggaatgaaattctgacacaggctacagcatggatggcccgaggtcattatgctgagtgaaataagccagtcacaacagggcacaccctgcgggattccgtaaacaaggcacctagagccgtcagattcagagagacagaaagtggactggaatttgagagcgtattttgcggtaaaactggccgaaggctaaagctgaccagaccggactccttggtgacctgtcctgcacaggggagtttacagagcagcccctcgatggagatcaagtga

SEQ ID NO: 17163 - DNA, 423 bp, Artificial Sequence; identical to SEQ ID NO: 6550
  Synthetic polypeptide

SEQ ID NO: 17164 - DNA, 540 bp, Artificial Sequence; identical to SEQ ID NO: 6513
  Synthetic polypeptide

SEQ ID NO: 17165 - DNA, 651 bp, Artificial Sequence; identical to SEQ ID NO: 6514
  Synthetic polypeptide

SEQ ID NO: 17166 - DNA, 569 bp, Artificial Sequence; identical to SEQ ID NO: 6515
  Synthetic polypeptide

SEQ ID NO: 17167 - DNA, 152 bp, Artificial Sequence; identical to SEQ ID NO: 6516
  Synthetic polypeptide

SEQ ID NO: 17168 - DNA, 471 bp, Artificial Sequence; identical to SEQ ID NO: 12833
  Synthetic polypeptide

SEQ ID NO: 17169 - DNA, 519 bp, Artificial Sequence; identical to SEQ ID NO: 12834
  Synthetic polypeptide

SEQ ID NO: 17170 - DNA, 293 bp, Artificial Sequence; identical to SEQ ID NO: 12835
  Synthetic polypeptide

SEQ ID NO: 17171 - DNA, 168 bp, Artificial Sequence; identical to SEQ ID NO: 12836
  Synthetic polypeptide

SEQ ID NO: 17172 - DNA, 126 bp, Artificial Sequence; identical to SEQ ID NO: 12837
  Synthetic polypeptide

SEQ ID NO: 17173 - DNA, 622 bp, Artificial Sequence
  Synthetic polypeptide
ctccctgggcctcagtctcctcttctgtaaaatggggagaacagaggcctccaccccacctcccggctgctggaagggcccaacgagacagctccaccatgcctgcaatggacccggcttgtctgtgctgtgcttcatgcgtcacgacatcctggagtatttcagtgtctacgggacagccctgagcatgtgggtctcgctgatggcactggccgacttcgacgaacccaagaggtcaacatttgtgatgttcggcgtcctgaccattgctgtgcggatctaccatgaccgatggggctacggggtgtactcgggccccatcggcacagccatcctcatcatcgcggcaaagtggctacagaagatgaaggagaagaagggcctgtacccagacaagagcgtctacacccagcagataggccccggcctctgcttcggggcgctggccctgatgctacgcttcttctttgaggactgggactacacttatgtccacagcttctaccactgtgccctggctatgtcctttgttctgctgctgcccaaggtcaacaagaaggctggatccccggggaccccggccaagctggactgctccaccctgtgctgtgcttgtgtctga

SEQ ID NO: 17174 - DNA, 369 bp, Artificial Sequence; identical to SEQ ID NO: 6492
  Synthetic polypeptide

SEQ ID NO: 17175 - DNA, 733 bp, Artificial Sequence; identical to SEQ ID NO: 6880
  Synthetic polypeptide

SEQ ID NO: 17176 - DNA, 273 bp, Artificial Sequence; identical to SEQ ID NO: 6881
  Synthetic polypeptide

SEQ ID NO: 17177 - DNA, 1045 bp, Artificial Sequence; identical to SEQ ID NO: 8898
  Synthetic polypeptide

SEQ ID NO: 17178 - DNA, 387 bp, Artificial Sequence; identical to SEQ ID NO: 16776
  Synthetic polypeptide

SEQ ID NO: 17179 - DNA, 1629 bp, Artificial Sequence; identical to SEQ ID NO: 8070
  Synthetic polypeptide

SEQ ID NO: 17180 - DNA, 1500 bp, Artificial Sequence; identical to SEQ ID NO: 8071
  Synthetic polypeptide

SEQ ID NO: 17181 - DNA, 2109 bp, Artificial Sequence; identical to SEQ ID NO: 14945
  Synthetic polypeptide

SEQ ID NO: 17182 - DNA, 1084 bp, Artificial Sequence; identical to SEQ ID NO: 580
  Synthetic polypeptide

SEQ ID NO: 17183 - DNA, 355 bp, Artificial Sequence; identical to SEQ ID NO: 8039
  Synthetic polypeptide

SEQ ID NO: 17184 - DNA, 322 bp, Artificial Sequence
  Synthetic polypeptide
ggccaagcacaatgagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaggtggcagctgccaacaagaagcattag

SEQ ID NO: 17185 - DNA, 191 bp, Artificial Sequence
  Synthetic polypeptide
ggccaagcacaatgagcttgctccctacgatgagaactggttctacacgcgagctggtggtttaatcctttctatatacacggaggcagactccctgggtttggatccatcttttacatctggctgtgtgtcctctgcttccacagcgcggcacctgtacctccggggtggcgctggggttggctccatga

SEQ ID NO: 17186 - DNA, 113 bp, Artificial Sequence
  Synthetic polypeptide
ggccaagcacaatgagcttgctccctacgatgagaactggttctacacgcgagctgcttccacagcgcggcacctgtacctccggggtggcgctggggttggctccatgacca

SEQ ID NO: 17187 - DNA, 103 bp, Artificial Sequence
  Synthetic polypeptide
ggccaagcacaatgagcttgctccctacgatgagaactggttctacacgcgagctgagttgcactgtcaccaggctggagtacactggtgccgtctcggctaa

SEQ ID NO: 17188 - DNA, 185 bp, Artificial Sequence
  Synthetic polypeptide
ggccaagcacaatgagcttgctccctacgatgagaactggttctacacgcgagctggtgaggaacttagcttccacagcgcggcacctgtacctccggggtggcgctggggttggctccatgaccaagatctatgggggacgtcagagaaacggcgtcatgcccagccacttcagccgaggctcc

SEQ ID NO: 17189 - DNA, 1871 bp, Artificial Sequence; identical to SEQ ID NO: 10627
  Synthetic polypeptide

SEQ ID NO: 17190 - DNA, 1625 bp, Artificial Sequence; identical to SEQ ID NO: 10628
  Synthetic polypeptide

SEQ ID NO: 17191 - DNA, 446 bp, Artificial Sequence; identical to SEQ ID NO: 10629
  Synthetic polypeptide

SEQ ID NO: 17192 - DNA, 1086 bp, Artificial Sequence; identical to SEQ ID NO: 6423
  Synthetic polypeptide

SEQ ID NO: 17193 - DNA, 330 bp, Artificial Sequence; identical to SEQ ID NO: 6490
  Synthetic polypeptide

SEQ ID NO: 17194 - DNA, 67 bp, Artificial Sequence; identical to SEQ ID NO: 16124
  Synthetic polypeptide

SEQ ID NO: 17195 - DNA, 1148 bp, Artificial Sequence
  Synthetic polypeptide
cagtgattctcaaactcaagagcctcgggttctggcaaggtgccttagggacacagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaa

SEQ ID NO: 17196 - DNA, 618 bp, Artificial Sequence; identical to SEQ ID NO: 12830
  Synthetic polypeptide

SEQ ID NO: 17197 - DNA, 594 bp, Artificial Sequence; identical to SEQ ID NO: 12831
  Synthetic polypeptide

SEQ ID NO: 17198 - DNA, 636 bp, Artificial Sequence; identical to SEQ ID NO: 12832
  Synthetic polypeptide

SEQ ID NO: 17199 - DNA, 545 bp, Artificial Sequence; identical to SEQ ID NO: 7336
  Synthetic polypeptide

SEQ ID NO: 17200 - DNA, 529 bp, Artificial Sequence; identical to SEQ ID NO: 12735
  Synthetic polypeptide

SEQ ID NO: 17201 - DNA, 1317 bp, Artificial Sequence; identical to SEQ ID NO: 12736
  Synthetic polypeptide

SEQ ID NO: 17202 - DNA, 1221 bp, Artificial Sequence; identical to SEQ ID NO: 12737
  Synthetic polypeptide

SEQ ID NO: 17203 - DNA, 1200 bp, Artificial Sequence; identical to SEQ ID NO: 12738
  Synthetic polypeptide

SEQ ID NO: 17204 - DNA, 922 bp, Artificial Sequence; identical to SEQ ID NO: 12739
  Synthetic polypeptide

SEQ ID NO: 17205 - DNA, 632 bp, Artificial Sequence; identical to SEQ ID NO: 12740
  Synthetic polypeptide

SEQ ID NO: 17206 - DNA, 836 bp, Artificial Sequence; identical to SEQ ID NO: 16203
  Synthetic polypeptide

SEQ ID NO: 17207 - DNA, 251 bp, Artificial Sequence; identical to SEQ ID NO: 10592
  Synthetic polypeptide

SEQ ID NO: 17208 - DNA, 369 bp, Artificial Sequence; identical to SEQ ID NO: 6429
  Synthetic polypeptide

SEQ ID NO: 17209 - DNA, 201 bp, Artificial Sequence; identical to SEQ ID NO: 6430
  Synthetic polypeptide

SEQ ID NO: 17210 - DNA, 224 bp, Artificial Sequence
  Synthetic polypeptide
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaa

SEQ ID NO: 17211 - DNA, 818 bp, Artificial Sequence
  Synthetic polypeptide
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaa

SEQ ID NO: 17212 - DNA, 1055 bp, Artificial Sequence
  Synthetic polypeptide
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaa

SEQ ID NO: 17213 - DNA, 923 bp, Artificial Sequence
  Synthetic polypeptide
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttga

SEQ ID NO: 17214 - DNA, 959 bp, Artificial Sequence
  Synthetic polypeptide
ggctaggcacagtggctcatgcctgtaatcccaacactttgggaggccaaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttga

SEQ ID NO: 17215 - DNA, 769 bp, Artificial Sequence; identical to SEQ ID NO: 6486
  Synthetic polypeptide

SEQ ID NO: 17216 - DNA, 493 bp, Artificial Sequence; identical to SEQ ID NO: 12530
  Synthetic polypeptide

SEQ ID NO: 17217 - DNA, 1206 bp, Artificial Sequence; identical to SEQ ID NO: 7670
  Synthetic polypeptide

SEQ ID NO: 17218 - DNA, 1134 bp, Artificial Sequence; identical to SEQ ID NO: 7671
  Synthetic polypeptide

SEQ ID NO: 17219 - DNA, 1002 bp, Artificial Sequence; identical to SEQ ID NO: 7672
  Synthetic polypeptide

SEQ ID NO: 17220 - DNA, 304 bp, Artificial Sequence
  Synthetic polypeptide
ggccgggtgcggtggctcctgcctgtaatctcagcactttgggaggctggggcgggccgatcccctgagtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaa

SEQ ID NO: 17221 - DNA, 280 bp, Artificial Sequence
  Synthetic polypeptide
ggccgggtgcggtggctcctgcctgtaatctcagcactttgggaggctggggcgggccgatcccctgagtggcgcttgaggctacaagtccaagtatcttcagctcaagaagaagttagaagatgagttccccggccgcctggacatcgtgagtcttgggatggggagaaagacttgagcacagccactgtgtcggtccgttaggcctggatggcactgcaggggggttagtgcggcgagggaactccccaggccaccgggttctttgaagtgatggtag

SEQ ID NO: 17222 - DNA, 354 bp, Artificial Sequence; identical to SEQ ID NO: 8772
  Synthetic polypeptide

SEQ ID NO: 17223 - DNA, 354 bp, Artificial Sequence; identical to SEQ ID NO: 8773
  Synthetic polypeptide

SEQ ID NO: 17224 - DNA, 309 bp, Artificial Sequence; identical to SEQ ID NO: 7876
  Synthetic polypeptide

SEQ ID NO: 17225 - DNA, 161 bp, Artificial Sequence; identical to SEQ ID NO: 7668
  Synthetic polypeptide

SEQ ID NO: 17226 - DNA, 178 bp, Artificial Sequence; identical to SEQ ID NO: 7669
  Synthetic polypeptide

SEQ ID NO: 17227 - DNA, 405 bp, Artificial Sequence; identical to SEQ ID NO: 7860
  Synthetic polypeptide

SEQ ID NO: 17228 - DNA, 274 bp, Artificial Sequence; identical to SEQ ID NO: 7861
  Synthetic polypeptide

SEQ ID NO: 17229 - DNA, 196 bp, Artificial Sequence; identical to SEQ ID NO: 7862
  Synthetic polypeptide

SEQ ID NO: 17230 - DNA, 268 bp, Artificial Sequence; identical to SEQ ID NO: 7863
  Synthetic polypeptide

SEQ ID NO: 17231 - DNA, 186 bp, Artificial Sequence; identical to SEQ ID NO: 7864
  Synthetic polypeptide

SEQ ID NO: 17232 - DNA, 893 bp, Artificial Sequence; identical to SEQ ID NO: 12957
  Synthetic polypeptide

SEQ ID NO: 17233 - DNA, 959 bp, Artificial Sequence; identical to SEQ ID NO: 12958
  Synthetic polypeptide

SEQ ID NO: 17234 - DNA, 1028 bp, Artificial Sequence; identical to SEQ ID NO: 12959
  Synthetic polypeptide

SEQ ID NO: 17235 - DNA, 887 bp, Artificial Sequence; identical to SEQ ID NO: 12960
  Synthetic polypeptide

SEQ ID NO: 17236 - DNA, 2434 bp, Artificial Sequence; identical to SEQ ID NO: 16042
  Synthetic polypeptide

SEQ ID NO: 17237 - DNA, 523 bp, Artificial Sequence; identical to SEQ ID NO: 8925
  Synthetic polypeptide

SEQ ID NO: 17238 - DNA, 648 bp, Artificial Sequence; identical to SEQ ID NO: 12806
  Synthetic polypeptide

SEQ ID NO: 17239 - DNA, 405 bp, Artificial Sequence; identical to SEQ ID NO: 12807
  Synthetic polypeptide

SEQ ID NO: 17240 - DNA, 627 bp, Artificial Sequence; identical to SEQ ID NO: 12808
  Synthetic polypeptide

SEQ ID NO: 17241 - DNA, 411 bp, Artificial Sequence; identical to SEQ ID NO: 12809
  Synthetic polypeptide

SEQ ID NO: 17242 - DNA, 570 bp, Artificial Sequence; identical to SEQ ID NO: 12810
  Synthetic polypeptide

SEQ ID NO: 17243 - DNA, 434 bp, Artificial Sequence; identical to SEQ ID NO: 8041
  Synthetic polypeptide

SEQ ID NO: 17244 - DNA, 2319 bp, Artificial Sequence; identical to SEQ ID NO: 6366
  Synthetic polypeptide

SEQ ID NO: 17245 - DNA, 1573 bp, Artificial Sequence
  Synthetic polypeptide
ggatacaaaatcaatgtacaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtctggtgagctgtaccttctttctggcagtgaatggtctgtattcctctagtgatgatgtgatcgaattaactccatcgaatttcaaccgagaagttattcagagtgatagtttgtggcttgtagaattctatgctccatggtgtggtcactgtcaaagattaacaccagaatggaagaaagcagcaactgcattaaaagatgttgtcaaagttggtgcagttgatgcagataagcatcattccctaggaggtcagtatggtgttcagggatttcctaccattaagatttttggatccaacaaaaacagaccagaagattaccaaggtggcagaactggtgaagccattgtagatgctgcgctgagtgctctgcgccagctcgtgaaggatcgcctcgggggacggagcggaggatacagttctggaaaacaaggcagaagtgatagttcaagtaagaaggatgtgattgagctgacagacgacagctttgataagaatgttctggacagtgaagatgtttggatggttgagttctatgctccttggtgtggacactgcaaaaacctagagccagagtgggctgccgcagcttcagaagtaaaagagcagacgaaaggaaaagtgaaactggcagctgtggatgctacagtcaatcaggttctggcctcccgatacgggattagaggatttcctacaatcaagatatttcagaaaggcgagtctcctgtggattatgacggtgggcggacaagatccgacatcgtgtcccgggcccttgatttgttttctgataacgccccacctcctgagctgcttgagattatcaacgaggacattgccaagaggacgtgtgaggagcaccagctctgtgttgtggctgtgctgccccatatccttgatactggagctgcaggcagaaattcttatctggaagttcttctgaagttggcagacaaatacaaaaagaaaatgtgggggtggctgtggacagaagctggagcccagtctgaacttgagaccgcgttggggattggagggtttgggtaccccgccatggccgccatcaatgcacgcaagatgaaatttgctctgctaaaaggctccttcagtgagcaaggcatcaacgagtttctcagggagctctcttttgggcgtggctccacggcacctgtaggaggcggggctttccctaccatcgttgagagagagccttgggacggcagggatggcgagcttcccgtggaggatgacattgacctcagtgatgtggagcttgatgacttagggaaagatgagttgtga

SEQ ID NO: 17246 - DNA, 543 bp, Artificial Sequence; identical to SEQ ID NO: 6496
  Synthetic polypeptide

SEQ ID NO: 17247 - DNA, 378 bp, Artificial Sequence; identical to SEQ ID NO: 6497
  Synthetic polypeptide

SEQ ID NO: 17248 - DNA, 267 bp, Artificial Sequence; identical to SEQ ID NO: 6498
  Synthetic polypeptide

SEQ ID NO: 17249 - DNA, 416 bp, Artificial Sequence; identical to SEQ ID NO: 6499
  Synthetic polypeptide

SEQ ID NO: 17250 - DNA, 162 bp, Artificial Sequence; identical to SEQ ID NO: 6500
  Synthetic polypeptide

SEQ ID NO: 17251 - DNA, 348 bp, Artificial Sequence; identical to SEQ ID NO: 6363
  Synthetic polypeptide

SEQ ID NO: 17252 - DNA, 299 bp, Artificial Sequence; identical to SEQ ID NO: 485
  Synthetic polypeptide

SEQ ID NO: 17253 - DNA, 790 bp, Artificial Sequence
  Synthetic polypeptide
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaagctgttgcagcgcagcatttcctccctgctgaggtttgccgccggtgaagatgggagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactag

SEQ ID NO: 17254 - DNA, 853 bp, Artificial Sequence
  Synthetic polypeptide
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagaggcgccttttcctgtggggactgctcccgggtggtcacatctcctgttctcaagaggcacctgcaggtcttcctggactgccgctcaagaccgcagtgcagagtgaaggtcaaggtaggagccaggccagagcacgcacgcactcctagctcactccaacatagcgaagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtga

SEQ ID NO: 17255 - DNA, 490 bp, Artificial Sequence
  Synthetic polypeptide
gctgactgagcttgtgcagctgaagagtctgctgcttctggagcaaagggagatctggctgctagtgaccgatgtcactctgcaaacgaaggaggagagagaccccaggctccccaaaaccctgctggtctatgtggcccccttgtgtgtgctgggctctgaagtcctggaggcactcgctggggctgcccctcacagcctcttcttcaaggacgctctccgtgaccagggtcggattgtttgtgctgaacgaactgtcctcttgcttcagaagccccttttgagtgtggtctctggtgcaagttcctgtgagctgcctggcccggtgatgctcgacagcctggactctgcaacacctgtcaactccatctgcagtgttcaaggcactgtggttggcgtggacgagagcactgctttctcatggcctgtgtgtgacatgtgtggcaacgggagattggaacagaggccggaagacagagctacgaagtga

SEQ ID NO: 17256 - DNA, 705 bp, Artificial Sequence
  Synthetic polypeptide
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacc

SEQ ID NO: 17257 - DNA, 759 bp, Artificial Sequence
  Synthetic polypeptide
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggact

SEQ ID NO: 17258 - DNA, 806 bp, Artificial Sequence
  Synthetic polypeptide
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctga

SEQ ID NO: 17259 - DNA, 359 bp, Artificial Sequence
  Synthetic polypeptide
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcacccca

SEQ ID NO: 17260 - DNA, 449 bp, Artificial Sequence
  Synthetic polypeptide
ctgctgattggtcaagactcagtgtgagtactgcctgccccaggaagcctgcttgacacactcagccatctgggctaggtgcccgtcttctgtgcttccaccattcttccagatgccccagtgtaactcttgcacctctggcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccgg

SEQ ID NO: 17261 - DNA, 427 bp, Artificial Sequence; identical to SEQ ID NO: 573
  Synthetic polypeptide

SEQ ID NO: 17262 - DNA, 2340 bp, Artificial Sequence; identical to SEQ ID NO: 14777
  Synthetic polypeptide

SEQ ID NO: 17263 - DNA, 383 bp, Artificial Sequence; identical to SEQ ID NO: 14778
  Synthetic polypeptide

SEQ ID NO: 17264 - DNA, 473 bp, Artificial Sequence; identical to SEQ ID NO: 13837
  Synthetic polypeptide

SEQ ID NO: 17265 - DNA, 191 bp, Artificial Sequence; identical to SEQ ID NO: 14798
  Synthetic polypeptide

SEQ ID NO: 17266 - DNA, 520 bp, Artificial Sequence; identical to SEQ ID NO: 6424
  Synthetic polypeptide

SEQ ID NO: 17267 - DNA, 96 bp, Artificial Sequence; identical to SEQ ID NO: 9766
  Synthetic polypeptide

SEQ ID NO: 17268 - DNA, 797 bp, Artificial Sequence; identical to SEQ ID NO: 14879
  Synthetic polypeptide

SEQ ID NO: 17269 - DNA, 552 bp, Artificial Sequence; identical to SEQ ID NO: 14880
  Synthetic polypeptide

SEQ ID NO: 17270 - DNA, 819 bp, Artificial Sequence; identical to SEQ ID NO: 14881
  Synthetic polypeptide

SEQ ID NO: 17271 - DNA, 120 bp, Artificial Sequence; identical to SEQ ID NO: 14806
  Synthetic polypeptide

SEQ ID NO: 17272 - DNA, 861 bp, Artificial Sequence; identical to SEQ ID NO: 16559
  Synthetic polypeptide

SEQ ID NO: 17273 - DNA, 616 bp, Artificial Sequence; identical to SEQ ID NO: 16560
  Synthetic polypeptide

SEQ ID NO: 17274 - DNA, 530 bp, Artificial Sequence; identical to SEQ ID NO: 16561
  Synthetic polypeptide

SEQ ID NO: 17275 - DNA, 378 bp, Artificial Sequence; identical to SEQ ID NO: 16562
  Synthetic polypeptide

SEQ ID NO: 17276 - DNA, 2197 bp, Artificial Sequence
  Synthetic polypeptide
agcatggactcaggagccagacttcctgagtctgaatcccagccctgcaacataccatctgagcagggtgctgctgtggggcccagcggccgtggagcatcacaagacgtgccggagcctgggcaggtcactgtggcagcagccgagtgtcggggacatccttcgcctgctggaccgggaccggatgatgcagaccatcctgcacttcccccagaaccggaggctgctgccccccgaggacacacaggagctgatattcaaagacaaaagcagggtggatcttgatggcctctatgacccctgctttctccttcagctcttcagtgagctgaccaggccagagtttgtggtggattgtcgaaaatttttggattcaaatgctctgggcctaactgtcacagccctcagcagctatgacccccagatgcgagccatagcctaccatgtcctggcggcctactactcgcacttggagggcgcacggttccaagagcagtcccagctactttacctgttggatgtagtccggaatgggattcgaactcaggacatgagacttacttttaccttggctctcttcattgccaaagcagccctgcagattttgaaaccagaggagcacatgtacctgaaggtcagcaacttcctgctgtcgcatgagtacttgaacatggacaaagtgccaggcttctaccagttcttctacagctccgactttgagcaaaaaacagagcagaagtgggtgtttggcgttctgcggcaggggatccgtgacaagcagtgctacgaactgtgtgcccggcgtggcatcttccacatcatcctgtccttcttccacagcccgctgtgtgacgaggcagcacagaattggattctggaaattctacagaatgctgcccaggttgccagatctgcgtatgaaatcatacgagactatagccttttaacatggattttacacatccttgaaagcaagtttctggagactccgctgctgtctaatgtgatctccttgctacacacactgtgggtgaccaacctgggggacaaggcagtggagtgggagagccagcgcctttgccagcctagctcccaggagcctgccaagcggcttgccctgcacctggtcaatgagttcctttatgttctcatcgtgctcatgaagcacctgaggcccaccttggcccccgtccagctgaccaacttcttcgggacacttgactccgtgctgaggtaccgggccactgtcatacaggcctttagggacatgaacagattcaccgtaaatgagacagtgctttccaccaaggacgtccttgtcctcttgcacaagtggagcctcattgaaagagacctcaagctccaggaagacctgagagcagccattgagaaggcccaagcccgggagctcatgaaaatgctcaaggataagaacaagcctgtcatgccagcccgagccaaaggcccacggggccgaaagaggaggcctggggaggcagaggagatggctgaccctgagctgatggcatctaccttggagacatgcaagggcctcctgaggtccatcttgacttactggagaccagtgatccctggtcctgaccccactcaggagcctgtggactcagccagccccgagagcgatgcgccaggccccgtatatgctgccgcttccctggcagtcagttgggtgctgcggtcggtggccgagcacccgctcagcagggcagaggctgcaggactcattggctggcttaagagccatattttgccacaccctgtggtcgtggctgacctccttaaggacagtgccgtgaggagcagcatattcaggctgtatagccggctctgtggggctgaggggctggcagggcctgtgcaggaggtggcctgcctgttcaatacggtcatgctgcagctggtggctgcccagggccgggcagggagccccttccacccggccatggaagccctctccctgtcttctctgagtgagaaggatgaagccacacaagcctccgcagcattcctagtgtctctctacataaaggacatctggctgggggctcagcggccggacaccctcttaacccacgtccggatggtgtgtgaggccgcagatgatgccccgagcagtgaagaggaggccatcgtggtgctctgcaaggacgccgccagcgcagcctcagatgcttga

SEQ ID NO: 17277 - DNA, 756 bp, Artificial Sequence; identical to SEQ ID NO: 8739
  Synthetic polypeptide

SEQ ID NO: 17278 - DNA, 871 bp, Artificial Sequence; identical to SEQ ID NO: 437
  Synthetic polypeptide

SEQ ID NO: 17279 - DNA, 421 bp, Artificial Sequence; identical to SEQ ID NO: 441
  Synthetic polypeptide

SEQ ID NO: 17280 - DNA, 638 bp, Artificial Sequence; identical to SEQ ID NO: 442
  Synthetic polypeptide

SEQ ID NO: 17281 - DNA, 337 bp, Artificial Sequence; identical to SEQ ID NO: 443
  Synthetic polypeptide

SEQ ID NO: 17282 - DNA, 1220 bp, Artificial Sequence; identical to SEQ ID NO: 14932
  Synthetic polypeptide

SEQ ID NO: 17283 - DNA, 1139 bp, Artificial Sequence; identical to SEQ ID NO: 14933
  Synthetic polypeptide

SEQ ID NO: 17284 - DNA, 1160 bp, Artificial Sequence; identical to SEQ ID NO: 14934
  Synthetic polypeptide

SEQ ID NO: 17285 - DNA, 409 bp, Artificial Sequence; identical to SEQ ID NO: 14926
  Synthetic polypeptide

SEQ ID NO: 17286 - DNA, 614 bp, Artificial Sequence; identical to SEQ ID NO: 14952
  Synthetic polypeptide

SEQ ID NO: 17287 - DNA, 1631 bp, Artificial Sequence; identical to SEQ ID NO: 7615
  Synthetic polypeptide

SEQ ID NO: 17288 - DNA, 1062 bp, Artificial Sequence; identical to SEQ ID NO: 14892
  Synthetic polypeptide

SEQ ID NO: 17289 - DNA, 80 bp, Artificial Sequence; identical to SEQ ID NO: 14893
  Synthetic polypeptide

SEQ ID NO: 17290 - DNA, 630 bp, Artificial Sequence; identical to SEQ ID NO: 14910
  Synthetic polypeptide

SEQ ID NO: 17291 - DNA, 360 bp, Artificial Sequence; identical to SEQ ID NO: 14911
  Synthetic polypeptide

SEQ ID NO: 17292 - DNA, 858 bp, Artificial Sequence; identical to SEQ ID NO: 14912
  Synthetic polypeptide

SEQ ID NO: 17293 - DNA, 768 bp, Artificial Sequence; identical to SEQ ID NO: 14913
  Synthetic polypeptide

SEQ ID NO: 17294 - DNA, 428 bp, Artificial Sequence; identical to SEQ ID NO: 14914
  Synthetic polypeptide

SEQ ID NO: 17295 - DNA, 360 bp, Artificial Sequence; identical to SEQ ID NO: 14809
  Synthetic polypeptide

SEQ ID NO: 17296 - DNA, 391 bp, Artificial Sequence
  Synthetic polypeptide
ccagtgttgaaggaggggcctgcagggaggtgtctgggtcatgggggtggatccctcatgagtgacttagtgccacccccttggcgatgagtgtgttcactcagatctggttgttcacaagtgtgtggctcctcctcaccccttgctcccactctcaccatgtggtgtgcctgttcctgcttcgccttccaccgtgaggaaaactccctgagggcctccccagaagctgagcagaggctgtggatcatcctgctgccagtccagctgctgcaagccctgctgctgccagtccagctgctgtgtccccgtgtgctgccagtccagctgctgcaagccctgttgctgccagtccaactgttgtgtccctgtgtgctgccagtgtaagatctga

SEQ ID NO: 17297 - DNA, 418 bp, Artificial Sequence; identical to SEQ ID NO: 14823
  Synthetic polypeptide

SEQ ID NO: 17298 - DNA, 1304 bp, Artificial Sequence; identical to SEQ ID NO: 9787
  Synthetic polypeptide

SEQ ID NO: 17299 - DNA, 1403 bp, Artificial Sequence; identical to SEQ ID NO: 9788
  Synthetic polypeptide

SEQ ID NO: 17300 - DNA, 1355 bp, Artificial Sequence; identical to SEQ ID NO: 9789
  Synthetic polypeptide

SEQ ID NO: 17301 - DNA, 322 bp, Artificial Sequence; identical to SEQ ID NO: 14839
  Synthetic polypeptide

SEQ ID NO: 17302 - DNA, 1401 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 17303 - DNA, 684 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtag

SEQ ID NO: 17304 - DNA, 819 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgagagccaggcgtggtag

SEQ ID NO: 17305 - DNA, 1539 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctggctgggtccgatacgccgagcgggtgctgggtcgccccatcactgcccacctctgcaccgccaagtccccccagcaggtcatgggctctttggtgaaggattatttcgccagacagcaggttcaggaggaaatgggctcagccttcccggttcttccaggaggctccactggctggggggctttgcagatgtttgggaggaccacacccagtcctgagggaggcagcagacagacatggatggagtgctggtgctcgaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggccaaggagctgttcaacgaggatgtggaggaggtcacttaccgagccctgagaaacaaagacttccaagaggtcacccttgagaagaacggagaggtggtgttacgctttgctgcagcctatggctttcgaaacatccagaacatgatcctgaagcttaagaagggcaagttcccattccactttgtggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtga

SEQ ID NO: 17306 - DNA, 462 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttgggatgctcccatttcccagtagcctccaggcctgcaggttcccatga

SEQ ID NO: 17307 - DNA, 816 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggctgggtccgatacgccgagcgggtgctgggtcgccccatcactgcccacctctgcaccgccaagtccccccagcaggtcatgggctctttggtgaaggattatttcgccagacagcagaacctgtctccagagaagattttccacgtcattgtggccccttgttatgacaagaagctggaggctcttcaggaaagccttccccctgctttgcatggctcccggggcgctgactgcgtgttaacatcaggtgaaattgctcaaataatggagcaaggtgacctctcagtgagagatgctgccgtcgacactctgtttggagacttgaaggaggacaaagtgacgcgtcatgatggagccagctcagacgggcacctggcacacatcttcagacatgcggcc

SEQ ID NO: 17308 - DNA, 597 bp, Artificial Sequence
  Synthetic polypeptide
cgggcatggtggctcacgcctggaatcccagcactttgggaggccgaggtggacggatcacttgaggtcaggagtttgagaccagcctggccaacatggtgaaaccttatctctgctaaaaatacaaaaattatccagaagggagaattccacaagttggctgatgccaagatatttttgagcgactgcctggcatgtgacagctgtatgactgcagaggaaggagtccaactttcccagcaaaatgccaaggacttcttccgcgttctgaaccttaacaagaaatgtgatacctcaaagcacaaagtgctggtagtgtctgtgtgtcctcaatctttgccttattttgctgctaaattcaacctcagtgtaactgatgcatccagaagactctgtggtttcctcaaaagtcttggggtgcactatgtatttgatacgacgatagctgcggattttagtatcctggagagtcaaaaagaattcgtgcgtcgctatcgccagcacagtgaggaggaacgcaccctgcccatgctgacctctgcctgtcctgggatgctcccatttcccagtagcctccaggcctgcaggttcccatga

SEQ ID NO: 17309 - DNA, 1067 bp, Artificial Sequence; identical to SEQ ID NO: 9936
  Synthetic polypeptide

SEQ ID NO: 17310 - DNA, 968 bp, Artificial Sequence; identical to SEQ ID NO: 9937
  Synthetic polypeptide

SEQ ID NO: 17311 - DNA, 1516 bp, Artificial Sequence; identical to SEQ ID NO: 534
  Synthetic polypeptide

SEQ ID NO: 17312 - DNA, 591 bp, Artificial Sequence; identical to SEQ ID NO: 539
  Synthetic polypeptide

SEQ ID NO: 17313 - DNA, 482 bp, Artificial Sequence; identical to SEQ ID NO: 540
  Synthetic polypeptide

SEQ ID NO: 17314 - DNA, 444 bp, Artificial Sequence; identical to SEQ ID NO: 541
  Synthetic polypeptide

SEQ ID NO: 17315 - DNA, 334 bp, Artificial Sequence; identical to SEQ ID NO: 533
  Synthetic polypeptide

SEQ ID NO: 17316 - DNA, 38 bp, Artificial Sequence; identical to SEQ ID NO: 543
  Synthetic polypeptide

SEQ ID NO: 17317 - DNA, 245 bp, Artificial Sequence; identical to SEQ ID NO: 542
  Synthetic polypeptide

SEQ ID NO: 17318 - DNA, 1227 bp, Artificial Sequence; identical to SEQ ID NO: 10479
  Synthetic polypeptide

SEQ ID NO: 17319 - DNA, 1299 bp, Artificial Sequence
  Synthetic polypeptide
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactga

SEQ ID NO: 17320 - DNA, 189 bp, Artificial Sequence
  Synthetic polypeptide
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgtgctcttctgcatttttaattag

SEQ ID NO: 17321 - DNA, 480 bp, Artificial Sequence
  Synthetic polypeptide
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctgatggagtcttgctatgttgcccaggctgatctcaaactcctggcctga

SEQ ID NO: 17322 - DNA, 218 bp, Artificial Sequence
  Synthetic polypeptide
gctgggaagggttcaaggagctaagccgagagttttggctgcccaccacagatatataatgaaaaggaattattacaaggtaaattggaccttcttagtgataccaacatggtagactttgctatggatgtatacaaaaacctttattctgatgatattcctcatgggatggtaggatgctctttgactacctggcggacaagcatggttttaggcag

SEQ ID NO: 17323 - DNA, 2073 bp, Artificial Sequence; identical to SEQ ID NO: 14983
  Synthetic polypeptide

SEQ ID NO: 17324 - DNA, 1708 bp, Artificial Sequence; identical to SEQ ID NO: 14810
  Synthetic polypeptide

SEQ ID NO: 17325 - DNA, 1687 bp, Artificial Sequence; identical to SEQ ID NO: 14811
  Synthetic polypeptide

SEQ ID NO: 17326 - DNA, 685 bp, Artificial Sequence; identical to SEQ ID NO: 14812
  Synthetic polypeptide

SEQ ID NO: 17327 - DNA, 589 bp, Artificial Sequence; identical to SEQ ID NO: 14813
  Synthetic polypeptide

SEQ ID NO: 17328 - DNA, 733 bp, Artificial Sequence; identical to SEQ ID NO: 14814
  Synthetic polypeptide

SEQ ID NO: 17329 - DNA, 745 bp, Artificial Sequence; identical to SEQ ID NO: 14815
  Synthetic polypeptide

SEQ ID NO: 17330 - DNA, 154 bp, Artificial Sequence; identical to SEQ ID NO: 14816
  Synthetic polypeptide

SEQ ID NO: 17331 - DNA, 96 bp, Artificial Sequence; identical to SEQ ID NO: 14817
  Synthetic polypeptide

SEQ ID NO: 17332 - DNA, 2825 bp, Artificial Sequence; identical to SEQ ID NO: 14951
  Synthetic polypeptide

SEQ ID NO: 17333 - DNA, 2477 bp, Artificial Sequence; identical to SEQ ID NO: 14819
  Synthetic polypeptide

SEQ ID NO: 17334 - DNA, 1101 bp, Artificial Sequence; identical to SEQ ID NO: 8142
  Synthetic polypeptide

SEQ ID NO: 17335 - DNA, 1896 bp, Artificial Sequence; identical to SEQ ID NO: 8143
  Synthetic polypeptide

SEQ ID NO: 17336 - DNA, 1662 bp, Artificial Sequence; identical to SEQ ID NO: 8144
  Synthetic polypeptide

SEQ ID NO: 17337 - DNA, 405 bp, Artificial Sequence; identical to SEQ ID NO: 7860
  Synthetic polypeptide

SEQ ID NO: 17338 - DNA, 274 bp, Artificial Sequence; identical to SEQ ID NO: 7861
  Synthetic polypeptide

SEQ ID NO: 17339 - DNA, 196 bp, Artificial Sequence; identical to SEQ ID NO: 7862
  Synthetic polypeptide

SEQ ID NO: 17340 - DNA, 268 bp, Artificial Sequence; identical to SEQ ID NO: 7863
  Synthetic polypeptide

SEQ ID NO: 17341 - DNA, 186 bp, Artificial Sequence; identical to SEQ ID NO: 7864
  Synthetic polypeptide

SEQ ID NO: 17342 - DNA, 1646 bp, Artificial Sequence
  Synthetic polypeptide
tttcctggttccctgactgggaagtgaggtgattggtggatggtcgaggcagctccttaggtgacttaagcctgccctgtggaacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctctgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttga

SEQ ID NO: 17343 - DNA, 757 bp, Artificial Sequence; identical to SEQ ID NO: 14961
  Synthetic polypeptide

SEQ ID NO: 17344 - DNA, 622 bp, Artificial Sequence; identical to SEQ ID NO: 14962
  Synthetic polypeptide

SEQ ID NO: 17345 - DNA, 340 bp, Artificial Sequence; identical to SEQ ID NO: 14963
  Synthetic polypeptide

SEQ ID NO: 17346 - DNA, 187 bp, Artificial Sequence; identical to SEQ ID NO: 14964
  Synthetic polypeptide

SEQ ID NO: 17347 - DNA, 1435 bp, Artificial Sequence; identical to SEQ ID NO: 14131
  Synthetic polypeptide

SEQ ID NO: 17348 - DNA, 340 bp, Artificial Sequence; identical to SEQ ID NO: 14132
  Synthetic polypeptide

SEQ ID NO: 17349 - DNA, 964 bp, Artificial Sequence; identical to SEQ ID NO: 15050
  Synthetic polypeptide

SEQ ID NO: 17350 - DNA, 355 bp, Artificial Sequence; identical to SEQ ID NO: 8039
  Synthetic polypeptide

SEQ ID NO: 17351 - DNA, 2356 bp, Artificial Sequence; identical to SEQ ID NO: 10008
  Synthetic polypeptide

SEQ ID NO: 17352 - DNA, 871 bp, Artificial Sequence; identical to SEQ ID NO: 10009
  Synthetic polypeptide

SEQ ID NO: 17353 - DNA, 2470 bp, Artificial Sequence; identical to SEQ ID NO: 10010
  Synthetic polypeptide

SEQ ID NO: 17354 - DNA, 1244 bp, Artificial Sequence
  Synthetic polypeptide
gccaggcacagcagctcatgcctgtcatctcagcactttgggagaccgaggcaggcggatcacctgaggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggagggctgtacagtggtgaggtgttggtgtgggacctgagccgtcttgaggacccgctgctgtggcgcacaggcctgacggatgacacccacacagaccctgtgtcccaggtggtgtggctgcccgagcctgggcacagccaccgcttccaggtgctgagtgtggccaccgacgggaaggtgctactctggcagggcatcggggtaggccagctgcagctcacagagggcttcgccctggtcatgcagcagctgccacggagcaccaagctcaagaagcatccccgcggggagaccgaggtgggcgccacggcagtggccttctccagctttgaccctaggctgttcattctgggcacggaaggcggcttcccgctcaagtgttccctggcagctggagaggcagccctcacgcggatgcccagctccgtgcccctgcgggccccagcacagtttaccttctccccccacggcggtcccatctactctgtgagctgttcccccttccacaggaatctcttcctgagcgctgggactgacgggcatgtccacctgtactccatgctgcaggcccctcccttgacttcgctgcagctctccctcaagtatctgtttgctgtgcgctggtccccagtgcggcccttggtttttgcagctgcctctgggaaaggtgacgtgcagctgtttgatctccagaaaagctcccagaaacccacagttttgatcaagcaaacccaggatgaaagccctgtctactgtctggagttcaacagccagcagactcagctcttggctgcgggcgatgcccagggcacagtgaaggtgtggcagctgagcacagagttcacggaacaagggccccgggaagctgaggacctggactgcctggcagcagaggtggcggcctga

SEQ ID NO: 17355 - DNA, 479 bp, Artificial Sequence
  Synthetic polypeptide
gccaggcacagcagctcatgcctgtcatctcagcactttgggagaccgaggcaggcggatcacctgaggtgtcttgtctgtataccctgggctacccgccagcccaagcgcagggtctgcatgtgaccagcatctcctggaactccactggctctgtggtggcctgtgcctacggccggctggaccatggggactggagcacgcttaagtccttcgtgtgtgcctggaacctggaccggcgagacctgcgtccccagcagccgtcggccgtggtggaggtccccagcgctgtcctgtgtctggccttccaccccacgcagccctcccacgtcgcaggtgagctgcctgctgtgtccgcctcctctcctctcaggactcagcttcccgccctgcagagggcacaagggagctttccatgggccctttggcccggagacaggaaggcgggccctgaccctctcagtctggagcccaggtga

SEQ ID NO: 17356 - DNA, 411 bp, Artificial Sequence
  Synthetic polypeptide
ggccggcgcggtgactcaggcctgtaatcccagcactttgggaggccgagctatacacagaatgggattttacatatgctggacagaaataagagaatcaagccccggccagaaagattccagaactgcaaagacctgtttgatctgatcctcacttgcgaagagagagtgtatgaccaggtggtggaagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactga

SEQ ID NO: 17357 - DNA, 282 bp, Artificial Sequence; identical to SEQ ID NO: 7621
  Synthetic polypeptide

SEQ ID NO: 17358 - DNA, 452 bp, Artificial Sequence
  Synthetic polypeptide
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccgttgaataaagaaacagaaaaaatagaacatactgaaaataatctaagttccaaccatagaagaagctgcagaagaaatgaagaaagtgatgatgatttagattttgatattgatttagaagacacaggaggagaccatcaaatgaattaa

SEQ ID NO: 17359 - DNA, 518 bp, Artificial Sequence
  Synthetic polypeptide
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtgtgttaaatgtttacaaaagacagtgaaggattcttatcacataatgtgcaggccatgtgcctgtgaacttgaagtttgcgcaaaatgtggaaagaaagaagacattgttattccatggagtctccctctgttgcccaggctggagtgcagtggcaggatcttggctcaccacaacctccgcctcccttgttcaagtgattctcctgcctcagcctctcgagtagctgggactacaggcgcacaccaccatgcccagctaatctttgtatttttagtagagatggggtttcactatgttggccaggccggtctcgaactcctgacctcatga

SEQ ID NO: 17360 - DNA, 188 bp, Artificial Sequence
  Synthetic polypeptide
caggggtccccagcccccgacccccgcatcggtccatggcctgtcaggaactgggccacacagcaggagttgaactgcagaaaattaatgcaaaacttcatgatggagtatgtcagcgctgtaaagaagttcttgagtggcgtgtaaaatacagcaaatacaaaccattatcaaaacctaaaaagtga

SEQ ID NO: 17361 - DNA, 1047 bp, Artificial Sequence; identical to SEQ ID NO: 8738
  Synthetic polypeptide

SEQ ID NO: 17362 - DNA, 711 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17363 - DNA, 501 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 17364 - DNA, 681 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17365 - DNA, 876 bp, Artificial Sequence
  Synthetic polypeptide
gggcgcggtggcttacatgtggaatcccaacactttgggaggctgaggcaggaagatcacctgaggtcaggagttcgagaccagcctgaccaaaatggagaaaccccatctctactgaaaatacaaaattagccgggcgtggtggtgcatgcctgtaatcctagctactcgggaggctgaggcaggagaattgcttgaacctgggaggcagaggttgcgcagatgggatcagagcggatggagatgcggaagcggcagatgcccgccgcccaggacacaccaggcgccgccccaggccagcccggagcggggagtcgcgggtccaacgcatgctgcttctgctggtgctgctgttgtagctgctcgtgtctcactgttagaaaccaggaagatcagaggcccacaatagcttcccacgaactcagagcagatcttccaacctgggaagaaagccctgctcctactctggaagaagtcaacgcctgggctcagtcatttgacaaattaatggtcactccagcaggaaggaatgcattccgtgaattcctccgaacagaattcagtgaggaaaatatgctcttctggatggcctgtgaggaactgaaaaaggaagctaataaaaacattattgaagagaaagcaaggataatctatgaagactacatttctatactttctcctaaggaggtgagcttagactcccgggtgagagaagtgatcaacagaaacatggtggagccatcccaacacatattcgatgatgctcaacttcagatttacaccctgatgcacagagactcatatcctcgattcatgaactctgctgtctataaggacttgcttcagtccttatcggagaaatctattgaagcatag

SEQ ID NO: 17366 - DNA, 1342 bp, Artificial Sequence; identical to SEQ ID NO: 10636
  Synthetic polypeptide

SEQ ID NO: 17367 - DNA, 1231 bp, Artificial Sequence; identical to SEQ ID NO: 10637
  Synthetic polypeptide

SEQ ID NO: 17368 - DNA, 145 bp, Artificial Sequence; identical to SEQ ID NO: 10638
  Synthetic polypeptide

SEQ ID NO: 17369 - DNA, 1441 bp, Artificial Sequence; identical to SEQ ID NO: 10639
  Synthetic polypeptide

SEQ ID NO: 17370 - DNA, 384 bp, Artificial Sequence; identical to SEQ ID NO: 10640
  Synthetic polypeptide

SEQ ID NO: 17371 - DNA, 665 bp, Artificial Sequence; identical to SEQ ID NO: 6374
  Synthetic polypeptide

SEQ ID NO: 17372 - DNA, 518 bp, Artificial Sequence; identical to SEQ ID NO: 6375
  Synthetic polypeptide

SEQ ID NO: 17373 - DNA, 153 bp, Artificial Sequence
  Synthetic polypeptide
gccagaattccagtgccagctccactcctcacgagctgtacaacctgggccggttactgacccctttcccaccttagttccctggctctacaatggaggtggcccgaggcagccgggatgacagctctccccaggaatcctgctgcctgctga

SEQ ID NO: 17374 - DNA, 1532 bp, Artificial Sequence; identical to SEQ ID NO: 14790
  Synthetic polypeptide

SEQ ID NO: 17375 - DNA, 1466 bp, Artificial Sequence; identical to SEQ ID NO: 14791
  Synthetic polypeptide

SEQ ID NO: 17376 - DNA, 139 bp, Artificial Sequence; identical to SEQ ID NO: 8939
  Synthetic polypeptide

SEQ ID NO: 17377 - DNA, 368 bp, Artificial Sequence; identical to SEQ ID NO: 8940
  Synthetic polypeptide

SEQ ID NO: 17378 - DNA, 2192 bp, Artificial Sequence; identical to SEQ ID NO: 8941
  Synthetic polypeptide

SEQ ID NO: 17379 - DNA, 1328 bp, Artificial Sequence; identical to SEQ ID NO: 8942
  Synthetic polypeptide

SEQ ID NO: 17380 - DNA, 2117 bp, Artificial Sequence; identical to SEQ ID NO: 8943
  Synthetic polypeptide

SEQ ID NO: 17381 - DNA, 1265 bp, Artificial Sequence; identical to SEQ ID NO: 8944
  Synthetic polypeptide

SEQ ID NO: 17382 - DNA, 1331 bp, Artificial Sequence; identical to SEQ ID NO: 8945
  Synthetic polypeptide

SEQ ID NO: 17383 - DNA, 153 bp, Artificial Sequence
  Synthetic polypeptide
gccagaattccagtgccagctccgctcctcacgagctgtacaacctgggccggttactgacccctttcccaccttagttccctggctctacaatggaggtggcccgaggcagccgggatgacagctctccccaggaatcctgctgcctgctga

SEQ ID NO: 17384 - DNA, 1720 bp, Artificial Sequence
  Synthetic polypeptide
tgatgtggtttggctctgtgtccccacccagatctcatcttgaataccatctcccagatttcccacatgttgtgggagggacccagggggaggtaattgaatcatgggggctggtctttcccatgctattctcgtgatagtgaataagtctcacgagatctgataggcttatcaggggtttccgcttttgctgctgcttcatttttctgttgctgccgccatgtgagaagtgtctttcacctcccgccatgattctgaggcctccccagccatgtggaactaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtag

SEQ ID NO: 17385 - DNA, 2051 bp, Artificial Sequence; identical to SEQ ID NO: 14965
  Synthetic polypeptide

SEQ ID NO: 17386 - DNA, 2030 bp, Artificial Sequence; identical to SEQ ID NO: 14966
  Synthetic polypeptide

SEQ ID NO: 17387 - DNA, 2051 bp, Artificial Sequence; identical to SEQ ID NO: 14967
  Synthetic polypeptide

SEQ ID NO: 17388 - DNA, 1925 bp, Artificial Sequence; identical to SEQ ID NO: 14968
  Synthetic polypeptide

SEQ ID NO: 17389 - DNA, 932 bp, Artificial Sequence; identical to SEQ ID NO: 14969
  Synthetic polypeptide

SEQ ID NO: 17390 - DNA, 1076 bp, Artificial Sequence; identical to SEQ ID NO: 14970
  Synthetic polypeptide

SEQ ID NO: 17391 - DNA, 941 bp, Artificial Sequence; identical to SEQ ID NO: 14971
  Synthetic polypeptide

SEQ ID NO: 17392 - DNA, 497 bp, Artificial Sequence; identical to SEQ ID NO: 14972
  Synthetic polypeptide

SEQ ID NO: 17393 - DNA, 439 bp, Artificial Sequence; identical to SEQ ID NO: 14973
  Synthetic polypeptide

SEQ ID NO: 17394 - DNA, 751 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17395 - DNA, 541 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgt

SEQ ID NO: 17396 - DNA, 721 bp, Artificial Sequence
  Synthetic polypeptide
ggggggaggggcgtgtgcgggaagggcgtgcgcgtgtgggaggggcgtgcgcgtgtgggaggggcgggtgcggggaggggcgcgcgtgcgtggggaggtgtgtgtgctgagatcgtgagtggaggcgtgtgtgagagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatag

SEQ ID NO: 17397 - DNA, 434 bp, Artificial Sequence; identical to SEQ ID NO: 8041
  Synthetic polypeptide

SEQ ID NO: 17398 - DNA, 768 bp, Artificial Sequence
  Synthetic polypeptide
gccgggccgcgccgccgctgccgccgccgcgcgcggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctga

SEQ ID NO: 17399 - DNA, 597 bp, Artificial Sequence
  Synthetic polypeptide
gccgggccgcgccgccgctgccgccgccgcgcgcggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctga

SEQ ID NO: 17400 - DNA, 271 bp, Artificial Sequence
  Synthetic polypeptide
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgaaacctgtggtggcccaccagtcctaa

SEQ ID NO: 17401 - DNA, 271 bp, Artificial Sequence
  Synthetic polypeptide
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgatgaaggagtggccccaaccaatgtga

SEQ ID NO: 17402 - DNA, 259 bp, Artificial Sequence
  Synthetic polypeptide
ggcagtgatatttctccctcgagtggctgggaaacttggcaagagaccagaggacccaaatgcagacccttcaagtgaggccaaggcaatggctgtgccctatcttctgagaagaaagttcagtaattccctgaaaagtcaaggtaaagatgatgattcttttgatcggaaatcagtgtaccgaggctcgctgacacagagaaaccccaacgcgaggaaaggaatggccagccacaccttcgcgtcaccgtcccaatga

SEQ ID NO: 17403 - DNA, 67 bp, Artificial Sequence; identical to SEQ ID NO: 16124
  Synthetic polypeptide

SEQ ID NO: 17404 - DNA, 807 bp, Artificial Sequence; identical to SEQ ID NO: 7401
  Synthetic polypeptide

SEQ ID NO: 17405 - DNA, 453 bp, Artificial Sequence; identical to SEQ ID NO: 7402
  Synthetic polypeptide

SEQ ID NO: 17406 - DNA, 812 bp, Artificial Sequence; identical to SEQ ID NO: 693
  Synthetic polypeptide

SEQ ID NO: 17407 - DNA, 752 bp, Artificial Sequence; identical to SEQ ID NO: 694
  Synthetic polypeptide

SEQ ID NO: 17408 - DNA, 2104 bp, Artificial Sequence; identical to SEQ ID NO: 9015
  Synthetic polypeptide

SEQ ID NO: 17409 - DNA, 333 bp, Artificial Sequence; identical to SEQ ID NO: 6583
  Synthetic polypeptide

SEQ ID NO: 17410 - DNA, 309 bp, Artificial Sequence; identical to SEQ ID NO: 7876
  Synthetic polypeptide

SEQ ID NO: 17411 - DNA, 804 bp, Artificial Sequence
  Synthetic polypeptide
gctcatgcctgtaatcccagcacttcgggaagattgcttgagcccaggagtttgagaccagcctgggcaatatagtgagagtttgtcttcacaaaaaatattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaa

SEQ ID NO: 17412 - DNA, 451 bp, Artificial Sequence
  Synthetic polypeptide
gctcatgcctgtaatcccagcacttcgggaagattgcttgagcccaggagtttgagaccagcctgggcaatatagtgagagtttgtcttcacaaaaaatattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattcc

SEQ ID NO: 17413 - DNA, 769 bp, Artificial Sequence; identical to SEQ ID NO: 6486
  Synthetic polypeptide

SEQ ID NO: 17414 - DNA, 678 bp, Artificial Sequence; identical to SEQ ID NO: 8918
  Synthetic polypeptide

SEQ ID NO: 17415 - DNA, 726 bp, Artificial Sequence; identical to SEQ ID NO: 8919
  Synthetic polypeptide

SEQ ID NO: 17416 - DNA, 1018 bp, Artificial Sequence
  Synthetic polypeptide
ctcacacctgtaaacccagcactttgggaggccaagatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatgaccacagtccattcctacacggccacccagaagacagtggacgggccatcaaggaaggcctggcgagatgggcggggtgcccaccagaacatcatcccagcctccactggggctgcgaaagctgtgaccaaagtcatcccagagctcaaagggaagctgacagggatggcgttccgggtaccaaccccggatgtgtctgtcgtggacctgacctgccgcctcgcccagcctgccccctactcagccatcaaggaggctgtaaaagcagcagccaaggggcccatggctggcatccttgcctacaccgaggatgaggtcgtctctacggacttcctcggtgatacccactcgtccatcttcgatgctaaggccggcattgcgctcaatgacaatttcgtgaagctcatttcatggtacgacaacgaatatggctacagtcaccgggtggtcgacctcctccgctacatgttcagccgagacaagtga

SEQ ID NO: 17417 - DNA, 104 bp, Artificial Sequence
  Synthetic polypeptide
ctcacacctgtaaacccagcactttgggaggccaagatttggacgcatcggtcgcctggtcctgcgcgcctgcatggagaagggtgttaaggtggtggctgtga

SEQ ID NO: 17418 - DNA, 532 bp, Artificial Sequence
  Synthetic polypeptide
ctcacacctgtaaacccagcactttgggaggccaagatttggacgcatcggtcgcctggtcctgcgcgcctgcatggagaagggtgttaaggtggtggctgtgaatgatccattcattgacccggaatacatggtgtacatgtttaagtatgactccacccacggccgatacaagggaagtgtggaattcaggaatggacaactggtcgtggacaaccatgagatctctgtctaccagtgcaaagagcccaaacagatcccctggagggctgtcgggagcccctacgtggtggagtccacaggcgtgtacctctccatacaggcagcttcggaccacatctctgcaggtgctcaacgtgtggtcatctccgcgccctcaccggatgcaccaatgttcgtcatgggtgtcaatgaaaatgactataaccctggctccatgaacattgtgagcaacgcgtcctgcaccaccaactgtttggctcccctcgccaaagtcatccacgagcgatttgggatcgtggaagggttgatg

SEQ ID NO: 17419 - DNA, 1397 bp, Artificial Sequence; identical to SEQ ID NO: 14804
  Synthetic polypeptide

SEQ ID NO: 17420 - DNA, 1331 bp, Artificial Sequence; identical to SEQ ID NO: 14805
  Synthetic polypeptide

SEQ ID NO: 17421 - DNA, 6602 bp, Artificial Sequence; identical to SEQ ID NO: 14996
  Synthetic polypeptide

SEQ ID NO: 17422 - DNA, 5960 bp, Artificial Sequence; identical to SEQ ID NO: 14997
  Synthetic polypeptide

SEQ ID NO: 17423 - DNA, 3305 bp, Artificial Sequence; identical to SEQ ID NO: 14998
  Synthetic polypeptide

SEQ ID NO: 17424 - DNA, 2693 bp, Artificial Sequence; identical to SEQ ID NO: 14999
  Synthetic polypeptide

SEQ ID NO: 17425 - DNA, 2201 bp, Artificial Sequence; identical to SEQ ID NO: 15000
  Synthetic polypeptide

SEQ ID NO: 17426 - DNA, 1325 bp, Artificial Sequence; identical to SEQ ID NO: 7686
  Synthetic polypeptide

SEQ ID NO: 17427 - DNA, 1691 bp, Artificial Sequence; identical to SEQ ID NO: 7687
  Synthetic polypeptide

SEQ ID NO: 17428 - DNA, 1541 bp, Artificial Sequence; identical to SEQ ID NO: 7688
  Synthetic polypeptide

SEQ ID NO: 17429 - DNA, 356 bp, Artificial Sequence
  Synthetic polypeptide
ggaaccttaatgaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17430 - DNA, 382 bp, Artificial Sequence; identical to SEQ ID NO: 434
  Synthetic polypeptide

SEQ ID NO: 17431 - DNA, 1029 bp, Artificial Sequence; identical to SEQ ID NO: 8732
  Synthetic polypeptide

SEQ ID NO: 17432 - DNA, 1170 bp, Artificial Sequence; identical to SEQ ID NO: 8733
  Synthetic polypeptide

SEQ ID NO: 17433 - DNA, 1062 bp, Artificial Sequence; identical to SEQ ID NO: 8734
  Synthetic polypeptide

SEQ ID NO: 17434 - DNA, 573 bp, Artificial Sequence; identical to SEQ ID NO: 8735
  Synthetic polypeptide

SEQ ID NO: 17435 - DNA, 299 bp, Artificial Sequence; identical to SEQ ID NO: 8736
  Synthetic polypeptide

SEQ ID NO: 17436 - DNA, 330 bp, Artificial Sequence; identical to SEQ ID NO: 6490
  Synthetic polypeptide

SEQ ID NO: 17437 - DNA, 653 bp, Artificial Sequence
  Synthetic polypeptide
tctggagctagctagcggccaggactccagttccactctgcttattagcgaatacttcagagagtcagagttgtgccagaagtctcttaatggcagatagaatgcaaatagttgtgattctctcagaattttttaataccacatggcaggaggcaaattgtgcaaattgtttaacaaacaacagtgaagaattatcaaacagcacagtatatttccttaatctatttaatcacaccctgacctgctttgaacataaccttcaggggaatgcacatagtcttttacagacaaaaaattattcagaagtatgcaaaaactgccgtgaagcatacaaaactctgagtagtctgtacagtgaaatgcaaaaaatgaatgaacttgagaataaggctgaacctggaacacatttatgcattgatgtggaagatgcaatgaacatcactcgaaaactatggagtcgaactttcaactgttcagtcccttgcagtgacacagtgcctgtaattgctgtttctgtgttcattctctttctacctgttgtcttctaccttagtagctttcttcactcagagcaaaagaaacgcaaactcattctgcccaaacgtctcaagtccagtaccagttttgcaaatattcaggaaaattcaaactga

SEQ ID NO: 17438 - DNA, 666 bp, Artificial Sequence; identical to SEQ ID NO: 15049
  Synthetic polypeptide

SEQ ID NO: 17439 - DNA, 449 bp, Artificial Sequence
  Synthetic polypeptide
aaattggagtttcactgaagaataagaaactcactcaaaaccacacaactacatggaaattgaacaaccttctcctgaatgactcctgggtaaataatgaaatcaaggcagaaatcaagaagttctttgaaaccaaagagaacaaagaaaacctctgggatgcagctaaagcagtgattcccgtgctcctgaacctgagccacgaccctgaggttggcctgcccgcaccgccgctcatgtatgccctggccttcggtgcttgcctgggaggtaacgggacactgattggcgcgtcggcaaacgtcgtgtgtgcagggattgcagaacagcatggatatgggttctccttcatggaatttttcaggctgggcttcccaatgatggttgtgtcctgcactgttgggatgtgttatctccttgtggctcatgtggtggtgggatggaattaa

SEQ ID NO: 17440 - DNA, 404 bp, Artificial Sequence; identical to SEQ ID NO: 6813
  Synthetic polypeptide

SEQ ID NO: 17441 - DNA, 417 bp, Artificial Sequence; identical to SEQ ID NO: 6814
  Synthetic polypeptide

SEQ ID NO: 17442 - DNA, 485 bp, Artificial Sequence; identical to SEQ ID NO: 6815
  Synthetic polypeptide

SEQ ID NO: 17443 - DNA, 1745 bp, Artificial Sequence; identical to SEQ ID NO: 6816
  Synthetic polypeptide

SEQ ID NO: 17444 - DNA, 1432 bp, Artificial Sequence; identical to SEQ ID NO: 14897
  Synthetic polypeptide

SEQ ID NO: 17445 - DNA, 1618 bp, Artificial Sequence; identical to SEQ ID NO: 14898
  Synthetic polypeptide

SEQ ID NO: 17446 - DNA, 1708 bp, Artificial Sequence; identical to SEQ ID NO: 14899
  Synthetic polypeptide

SEQ ID NO: 17447 - DNA, 1558 bp, Artificial Sequence; identical to SEQ ID NO: 14900
  Synthetic polypeptide

SEQ ID NO: 17448 - DNA, 1774 bp, Artificial Sequence; identical to SEQ ID NO: 14901
  Synthetic polypeptide

SEQ ID NO: 17449 - DNA, 508 bp, Artificial Sequence; identical to SEQ ID NO: 14902
  Synthetic polypeptide

SEQ ID NO: 17450 - DNA, 418 bp, Artificial Sequence; identical to SEQ ID NO: 11223
  Synthetic polypeptide

SEQ ID NO: 17451 - DNA, 418 bp, Artificial Sequence; identical to SEQ ID NO: 11223
  Synthetic polypeptide

SEQ ID NO: 17452 - DNA, 418 bp, Artificial Sequence; identical to SEQ ID NO: 11223
  Synthetic polypeptide

SEQ ID NO: 17453 - DNA, 386 bp, Artificial Sequence; identical to SEQ ID NO: 11224
  Synthetic polypeptide

SEQ ID NO: 17454 - DNA, 418 bp, Artificial Sequence; identical to SEQ ID NO: 11223
  Synthetic polypeptide

SEQ ID NO: 17455 - DNA, 457 bp, Artificial Sequence; identical to SEQ ID NO: 11225
  Synthetic polypeptide

SEQ ID NO: 17456 - DNA, 496 bp, Artificial Sequence; identical to SEQ ID NO: 11226
  Synthetic polypeptide

SEQ ID NO: 17457 - DNA, 1262 bp, Artificial Sequence
  Synthetic polypeptide
ggctgctcgcggtgactcacgcttgtaatcccagcactttgggaggccaaggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 17458 - DNA, 1217 bp, Artificial Sequence
  Synthetic polypeptide
ggctgctcgcggtgactcacgcttgtaatcccagcactttgggaggccaaggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctga

SEQ ID NO: 17459 - DNA, 385 bp, Artificial Sequence; identical to SEQ ID NO: 11229
  Synthetic polypeptide

SEQ ID NO: 17460 - DNA, 418 bp, Artificial Sequence; identical to SEQ ID NO: 11223
  Synthetic polypeptide

SEQ ID NO: 17461 - DNA, 385 bp, Artificial Sequence; identical to SEQ ID NO: 11229
  Synthetic polypeptide

SEQ ID NO: 17462 - DNA, 418 bp, Artificial Sequence; identical to SEQ ID NO: 11223
  Synthetic polypeptide

SEQ ID NO: 17463 - DNA, 385 bp, Artificial Sequence; identical to SEQ ID NO: 11229
  Synthetic polypeptide

SEQ ID NO: 17464 - DNA, 1653 bp, Artificial Sequence
  Synthetic polypeptide
gaaataatccctaagtacctttacctcctcctttagtaaagcctgttcagcacaggggaacacacccaggtgaagattggcaaatagactacactcaaatacccccatgggaaggattcaaatatttattagtattcatcgatacctttacttgttggattgaagcttttcctacctggtctgaaaaggcaactgacatttctaaatttttattaaaggaaataatccctaagtttgggctgcctaaaagcttacagaatggctcatttttcacagcaacaagaacccaaaatatatcaccggctctaggaattcagtatcatctttattcagcatggaggccacagtttgcaggaaaagtagaaagggccaaacttcaaagaggactcttgccaagttatgccaggaaacatcagaaacctattcgtctctattgcctgtggccttgttgctagttttggctgcccctaagggaaacttgcagctcagctctttcgaaataatgtatggaagtcctttcttaactgcagatttcctagtagatatagatactttcaaattacagaactacgttattaacttaggtcgggtgcaaaaagctcttcttgaatatggaaatcagagacttcctccctccactaaggaagaaaatgctacaatccagccaggaaactgggttctattaaaaacttggaaggaagggtctccgttagatcaaccttccccaaagtacttgtacaaagtactctaccaagtactccttagtacccaaactgcaattaaacttcaaggaataagcagctgggttcatttatctcgaattaaacccatttcttatgaagtcccacaggctgagactgatctcacttatccctgtgtaccaaccactgatctctggcgcctgctcagaagaaacaagaaggatgaataacttaaagatttggattaacatcttaattctgcgcatgtattggaaccagctaagaagcaatctctttgccaaatgggcacagactttagcctccctacacaacaacactaattgctgagtatgcacggaactaatgcctcctccacctcaggctgccctggcacatcctgccagccactatgagcatatggggaaattattatgattggggtaaatggaccaccctttttcccttctactacagaaacacagggcccagccctttcccttcccaccgtgaaacaaagaagcctcttttttgtttgatcagaaaattaaactccactctgacgtaaggttatactgtacacgatgaatggatgacagctgtctaagttcaggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17465 - DNA, 763 bp, Artificial Sequence; identical to SEQ ID NO: 606
  Synthetic polypeptide

SEQ ID NO: 17466 - DNA, 2252 bp, Artificial Sequence
  Synthetic polypeptide
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcaggtaagaatattaatttccttctctatacaggggctgcttgctctgttttggcacattatgaagaggctttatcatcccgagactgtatgatcacagggataaatggacaagctcataggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17467 - DNA, 170 bp, Artificial Sequence; identical to SEQ ID NO: 14976
  Synthetic polypeptide

SEQ ID NO: 17468 - DNA, 459 bp, Artificial Sequence; identical to SEQ ID NO: 6625
  Synthetic polypeptide

SEQ ID NO: 17469 - DNA, 2792 bp, Artificial Sequence; identical to SEQ ID NO: 16266
  Synthetic polypeptide

SEQ ID NO: 17470 - DNA, 2130 bp, Artificial Sequence
  Synthetic polypeptide
gtgatcacaggatcattttcccttgctcatttggctctgaaagctctttcatcctttttagtggagcttggccagtggcagtacaaccttattcacaatgatctctattttcacctttacctgctcccttcatgggtaacacagccttaatcctaaaaagctcaccactagggtacatattagagcattgggaccaatttaaattaggtgggcttaagaaaaagaaatgtttatttttatgtaatattgtttggccctaatagggccaaataataatgttattattccaaataataataatgttatttggaaagtcaagaaaaatggccacctaatggaactacagcctttaatagttatacttcaacttgatttgttttgcaagcaggagggaaaatggggtgaaataccatatgttcaaacatttctattgcttagtcaggataaaactttaaaacaagcatgtgcatatttaatgaaaataaaagaggaaaactaattagatattctagatgatctttcaatgcaagccttggtcagttccaatgcttcaggtgcatctgcccctgtcccttctagcccttctagtagttctgttgagacctcttcatctcatcctccttacccgtctagccctattttacatctacctccttctgagatgcttagtcctattctgtacccgttactccctgaggaacccagccccacctgtattacccatagtggagcctcttagcaactttcaaaggaaaatctttgcttagagaagtggtaaatggggaacagggcactataagggtatgtgtccctttttctatgtctgatttggcattatgcaaagaaaaatttggttgtttctctgaagacctaggaaaatttatagatgagtttgagaaactaactctgacataatttaacctggcaggatttgcatattttgttatccacctgctgtacagtggaagaaaaacagtggattttggaaatagctaggacacatgcagatgaaatgctatcccacaattctaatcatactatctacagggttgggggtattgcagttcctgatcaaaatcgaggatggaatgatcaaaggaatagtgaagactgagaagagagatcacatgatcacttgtttattagaagggataaacacatgtacgaaaaaacatgttaattatgataacgtgaaggaagttacccaaggtaaagatgagaatctggctttgtttcagggacaattgaggcaattaggaaatacactgatcccacttcaaaaggacaaacctgattaggggtacattgtataatccagtctgcccttgatatccattggaaactgcaaaaaaagcagccttggttccccagactactatgaaccagttttgggacacggcatttatggtttttaataacaaggacaagacagagaaagcagaaaaacttaagacagcttctcaaaaggaacagctcttagctgtggccttaagcttgccacacatatgggggttgcccttacacttctcagccttggcaagggaagctagaaggcagaaagccccaatctgggcttccagatcaccgcaacttgaatataaattaatgtgcttgctgtaagacaactggccattaggaagaggcgcaccactcactctcgggtttgctcagacatccttagtttaggtgctgaaggccaagagtgatggggctcaagaccttctgccacagctctcattgggcaacaaaaccatgtatctggaggatcctggggtaacccttgaagtggcagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17471 - DNA, 2184 bp, Artificial Sequence
  Synthetic polypeptide
ttctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgcaggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaacgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatag

SEQ ID NO: 17472 - DNA, 740 bp, Artificial Sequence
  Synthetic polypeptide
ttctcaaagtgtgatcctgcagacttctgagagttccagagacattttcaggaagtctgcagttccaaactgttttccttataatacgaagattttattcatccttttttccccactgtgttgacatttgccccaatggtgcaaaagagaaatggtgggtaaaagcatggcaccaaactataaagtcatcattgtattcttgatggccacgtagttgcaggaggaagaaatctagtttcacttaagaatgtctttgatggaacagtaaacattattcatgttattaaaggtcaatccttgactatatacctttgtaacattctgtgtgacaaaatgggaaatatgctaaaagcattcctgcttcatactgaaatactgttgtgtctcaaggaaaagcacttgtgtgattgagttgttagctgagctagccactttttgcatggaacaccatttttactttgaaagaatgacagacaaaccatactgtggaactggcagatttttcagacattgtctaaaaaacgaatgaactgcgcctgttacttcagggaaaacaactctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtg

SEQ ID NO: 17473 - DNA, 579 bp, Artificial Sequence
  Synthetic polypeptide
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggttcacttgtcaaggatgagtgtttccaattctacaaataaaaattgtattattttctag

SEQ ID NO: 17474 - DNA, 1290 bp, Artificial Sequence
  Synthetic polypeptide
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaaggatataatgaaagatgaatgctcgatgctcaagctgcagctgaaagagaaggatgaactcatttcccaacttcaggaagagctgggaaaagtccggcatttacagaaggcttttgcttcaagagtagataaatccacacagactgaactactatgctatgatggtttaaacttgaaaagactagagacagtacaaggagggagagaggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaa

SEQ ID NO: 17475 - DNA, 621 bp, Artificial Sequence
  Synthetic polypeptide
aagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaacttttgccgggaggactcatatcactctgtcgtctcatgtgccgcagtagttcttactcctatggaaccaatgatagaaatgaagaaaagagaagaaccagaatttcctgagccttccaaacagaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagagagtgcagacatgagtccagcaagcagtaccacgtcacttcctgttagtcctcttactgaagagccagtgcctttcaagaccacataccctagggaattctga

SEQ ID NO: 17476 - DNA, 1268 bp, Artificial Sequence
  Synthetic polypeptide
ggattgtagagtcagatcgcctggctttctgtctttctcccatgggtctgggctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaagaactactgggcatgtgctttggggaccggtattatcgggaaccatttgtgcaacgacagaggacttccaggctcttcagcatttccaacaggatcacagacctgggcctgtccccacacctcactgcgctcatggcaggtggacagcccctggggcacagcagcagcacgggggacactggcttcagctgctcccaggactcagggacagatatgatgctgcttgaggactacacgtctgatgacaaccctccctctcactgcacttgcccacccaagagaaggagctcggtgacatttgaggatgaagtggaacaaatcaaagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatga

SEQ ID NO: 17477 - DNA, 711 bp, Artificial Sequence; identical to SEQ ID NO: 7377
  Synthetic polypeptide

SEQ ID NO: 17478 - DNA, 600 bp, Artificial Sequence
  Synthetic polypeptide
ggatgcagagggccctgaatccaagtcctgttctgccatccaaccccaaggccctgggcggatgccgtgacctctgagcctccataattcctgtaagcgatctggagacacgagtgtccatgagaagtaaatgaaataatgcaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtga

SEQ ID NO: 17479 - DNA, 1483 bp, Artificial Sequence
  Synthetic polypeptide
gaaataatccctaagtacctttacctcctcctttagtaaagcctgttcagcacaggggaacacacccaggtgaagattggcaaatagactacactcaaatacccccatgggaaggattcaaatatttattagtattcatcgatacctttacttgttggattgaagcttttcctacctggtctgaaaaggcaactgacatttctaaatttttattaaaggaaataatccctaagtttgggctgcctaaaagcttacagaatggctcatttttcacagcaacaagaacccaaaatatatcaccggctctaggaattcagtatcatctttattcagcatggaggccacagtttgcaggaaaagtagaaagggccaaacttcaaagaggactcttgccaagttatgccaggaaacatcagaaacctattcgtctctattgcctgtggccttgttgctagttttggctgcccctaagggaaacttgcagctcagctctttcgaaataatgtatggaagtcctttcttaactgcagatttcctagtagatatagatactttcaaattacagaactacgttattaacttaggtcgggtgcaaaaagctcttcttgaatatggaaatcagagacttcctccctccactaaggaagaaaatgctacaatccagccaggaaactgggttctattaaaaacttggaaggaagggtctccgttagatcaaccttccccaaagtacttgtacaaagtactctaccaagtactccttagtacccaaactgcaattaaacttcaaggaataagcagctgggttcatttatctcgaattaaacccatttcttatgaagtcccacaggctgagactgatctcacttatccctgtgtaccaaccactgatctctggcgcctgctcagaagaaacaagaaggatgaataacttaaagatttggattaacatcttaattctgcgcatgtattggaaccagctaagaagcaatctctttgccaaatgggcacagactttagcctccctacacaacaacactaattgctgagtatgcacggaactaatgcctcctccacctcaggctgccctggcacatcctgccagccactatgagcatatggggaaattattatgattggggaagatcagcccatctacttggcagtgaagggagtggtgtttgatgtcacctccggaaaggagttttatggacgaggagccccctacaatgccttgacggggaaggactccactagaggggtagccaagatgtccttggatcctgcagacctcacccatgacactacgggtctcacggccaaggaactggaggccctggatgaggtcttcaccaaagtgtacaaagccaaataccccatcgtcggctacactgcccggagaattctcaatgaggatggcagccctaacctggacttcaagcctgaagaccagccccattttgacatcaaggatgagttctga

SEQ ID NO: 17480 - DNA, 1998 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17481 - DNA, 1977 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17482 - DNA, 1998 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctacaggtatgacacctgcagaggtatcaattgtggtgctttctggaaccacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17483 - DNA, 1872 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatggtgaccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctggacattgtccagggtattgaaagtgccgagatcctgcaggctgtgccgtccggtgagggggatgcatttgagctgactgtgtcctgccaaggcgggctgcccaaggaagcctgcatggagatctcatcgccagggtgccagccccctgcccagcggctgtgccagcctgtgctacccagcccagcctgccagctggttctgcaccagatactgaagggtggctcggggacatactgcctcaatgtgtctctggctgataccaacagcctggcagtggtcagcacccagcttatcatgcctgtgcctgggattcttctcacaggtcaagaagcaggccttgggcaggttccgctgatcgtgggcatcttgctggtgttgatggctgtggtccttgcatctctgatatataggcgcagacttatgaagcaagacttctccgtaccccagttgccacatagcagcagtcactggctgcgtctaccccgcatcttctgctcttgtcccattggtgagaacagccccctcctcagtgggcagcaggtctga

SEQ ID NO: 17484 - DNA, 879 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacagctgcacaggtaacaactacagagtgggtggagaccacagctagagagctacctatccctgagcctgaaggtccagatgccagctcaatcatgtctacggaaagtattacaggttccctgggccccctgctggatggtacagccaccttaaggctggtgaagagacaagtccccctggattgtgttctgtatcgatatggttccttttccgtcaccctg

SEQ ID NO: 17485 - DNA, 1023 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttatgtctggaagacctgggaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaaccacatctgtgcaggtgccaaccactgaagtcataagcactgcacctgtgcagatgccaactgcagagagcacaggtatgacacctgagaaggtgccagtttcagaggtcatgggtaccacactggcagagatgtcaactccagaggctaca

SEQ ID NO: 17486 - DNA, 888 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagagggagccaggtgtggggaggacagccagtgtatccccaggaaactgacgatgcctgcatcttccctgatggtggaccttgcccatctggctcttggtctcagaagagaagctttgtttatgtctggaagacctggggccaatactggcaagttctagggggcccagtgtctgggctgagcattgggacaggcagggcaatgctgggcacacacaccatggaagtgactgtctaccatcgccggggatcccggagctatgtgcctcttgctcattccagctcagccttcaccattactgaccaggtgcctttctccgtgagcgtgtcccagttgcgggccttggatggagggaacaagcacttcctgagaaatcagcctctgacctttgccctccagctccatgaccccagtggctatctggctgaagctgacctctcctacacctgggactttggagacagtagtggaaccctgatctctcgggcacttgtggtcactcatacttacctggagcctggcccagtcactgcccaggtggtcctgcaggctgccattcctctcacctcctgtggctcctccccagttccaggcaccacagatgggcacaggccaactgcagaggcccctaacaccacagctggccaagtgcctactacagaagttgtgggtactacacctggtcaggcgccaactgcagagccctctggaacc

SEQ ID NO: 17487 - DNA, 444 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatcttccctgatggtggaccttgcccatctggctcttggtctcagaagagaagctttgtttat

SEQ ID NO: 17488 - DNA, 386 bp, Artificial Sequence
  Synthetic polypeptide
ggccgggcgccgtggctcacgcctgtaatcccagcactttgggaggctgaagcaggtggatcacgagtacccagaaaccaggactggcttggtgtctcaaggcaactcagaaccaaagcctggaacaggcagctgtatccagagtggacagaagcccagagacttgactgctggagaggtggtcaagtgtccctcaaggtcagtaatgatgggcctacactgattggtgcaaatgcctccttctctattgccttgaacttccctggaagccaaaaggtattgccagatgggcaggttatctgggtcaacaataccatcatcaatgggagccaggtgtggggaggacagccagtgtatccccaggaaactgacgatgcctgcatctt

SEQ ID NO: 17489 - DNA, 1330 bp, Artificial Sequence
  Synthetic polypeptide
tgatatggtttggctgtgtccccactcaaatctaatcttgaattgtacccataatccccaggtgttgtgggtggatcagctggagataattgaatcatgggggcagttttccccatcgtattctcgtgatagttagttctcacgagacctaatgattttaaataaggagcttctccttttgctgggtgttcattcttctgcttgctgctgccatgtgaagaaggatgtgtttgcttccccttctgccatgatcatcaatgaactgagccatgttcaaatccctgttatgttgatgccagatgacttcaaagcctattcaaaaataaaggtggacaatcacctttttaacaaagaaaacatgccgagccatttcaagtttaaggaatactgcccgatggtcttccgtaacctgcgggagaggtttggaattgatgatcaagatttccagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaagggctctacagtggctagagaagctagtgacaaagaaaaggccaaagaactgccaactctgaaagataatgatttcattaatgagggccaaaagatttatattgatgacaacaacaagaaggtcttcctggaaaaactaaaaaaggatgttgagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaaactcgcctaggaaggaggtgtacttcatggcaattattgacatccttactcattatgatgcaaaaaagaaagctgcccatgctgcaaaaactgttaaacatggcgctggcgcggagatctccaccgtgaacccagaacagtattcaaagcgctttttggactttattggccacatcttgacgtaa

SEQ ID NO: 17490 - DNA, 1522 bp, Artificial Sequence; identical to SEQ ID NO: 15029
  Synthetic polypeptide

SEQ ID NO: 17491 - DNA, 195 bp, Artificial Sequence; identical to SEQ ID NO: 15051
  Synthetic polypeptide

SEQ ID NO: 17492 - DNA, 271 bp, Artificial Sequence
  Synthetic polypeptide
ggccggcgcggtgactcaggcctgtaatcccagcactttgggaggccgagatctgaattccagagaacaggagacctgccagcctgtgcacgtggtcaatgtggacatccaggacaaccacgaggaggccaccctgggggcgtttctcatctgtgagctctgccagtgtatccagcacacggaagacatggagaacgagatcgacgagctgctgcaggagttcgaggagaagagtggccgcacctttctgcacaccgtctgcttctactga

SEQ ID NO: 17493 - protein, 9 aa, Artificial Sequence
  synthetic polypeptide
RQAPGFHHA

SEQ ID NO: 17494 - protein, 9 aa, Artificial Sequence
  synthetic polypeptide
GLPSHVELA

SEQ ID NO: 17495 - protein, 9 aa, Artificial Sequence
  synthetic polypeptide
LLHLESFLV

SEQ ID NO: 17496 - protein, 9 aa, Artificial Sequence
  synthetic polypeptide
LLTSWHLYL
